United States Patent 12,569,549 (FLAVIVIRUS VACCINE) - sequence listing, part 20

SEQ ID NO: 9158 - RNA, 9876 nt, synthetic construct
  misc_feature 1..9876: note = derived and/or modified CDS sequence (opt1) from DENV-2__FJ639697__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagagcctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaaggagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagctccaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggctccaactggatccagaaggagacgctggtgaccttcaagaacccccacgcgaagaagcaggacgtggtcgtgctcgggagccaggagggcgccatgcacaccgccctgaccggggccacggagatccagatgagctccggcaacctcctgttcaccggccacctgaagtgccgcctgcggatggacaagctccagctgaaggggatgagctactccatgtgcaccggcaagttcaagatcgtcaaggagatcgccgagacccagcacgggacgatcgtgatccgcgtgcagtacgagggcgacggcagcccctgcaagatccccttcgagatcatggacctggagaagcggcacgtcctcgggcgcctgatcaccgtgaacccgatcgtgaccgagaaggactcccccgtcaacatcgaggcggagccgcccttcggcgacagctacatcatcatcggggtggagccgggccagctgaagctcaactggttcaagaaggggtccagcatcggccagatgttcgagaccacgatgcgcggcgccaagcggatggccatcctgggggacaccgcctgggacttcggctccctcggcggggtgttcaccagcatggggaaggccctccaccaggtcttcggggcgatctacggcgccgccttctccggggtgagctggaccatgaagatcctgatcggcgtgatcatcacgtggatcgggatgaactcccgcagcacctccctgagcgtctccctggtgctcgtgggcgtcatcaccctgtacctgggggccatggtgcaggcggacagcggctgcgtggtctcctggaagaacaaggagctcaagtgcggcagcgggatcttcatcaccgacaacgtgcacacgtggaccgagcagtacaagttccagcccgagagcccctccaagctggccagcgccatccagaaggcccacgaggagggcatctgcgggatccggtccgtgacccgcctggagaacctcatgtggaagcagatcacccccgagctgaaccacatcctgagcgagaacgaggtcaagctcacgatcatgaccggcgacatcaaggggatcatgcaggccggcaagcggtccctgcgcccgcagcccaccgagctgaagtacagctggaagacctggggcaaggcgaagatgctctccacggagagccacaaccagaccttcctgatcgacgggcccgagaccgccgagtgcccgaacaccaaccgggcctggaactccctggaggtggaggactacggcttcggggtgttcacgaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagagcttcgccgggcccgtgagccagcacaactaccgcccgggctactacacccagacggcggggccctggcacctcggcaagctggagatggacttcgacttctgcgaggggaccaccgtggtcgtgaccgaggactgcggcaaccggggcccctccctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcgtgggcaccaagcacgcgatcctgctcgtcgccgtgagcttcgtgacgctgatcaccgggaacatgtccttccgggacctgggccgcgtcatggtgatggtgggggccaccatgaccgacgacatcggcatgggcgtcacgtacctcgccctgctggccgcgttcaaggtgcgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtgctgaagatcgtccgcaacatggagaagtaccagctcgccgtgaccatcatggccatctcctgcgtgccgaacgccgtcatcctgcagaacgcgtggaaggtgagctgcacgatcctggccgccgtgtccgtcagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtgggcatggtcagcatcctcgccagctccctgctgaagaacgacatccccatgaccgggcccctcgtggcgggcgggctgctgacggtgtgctacgtcctcaccggccggagcgccgacctggagctggagcgcgccaccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcgggctgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagaaggggatcctcggctactcccagatcggcgcgggggtgtacaaggagggcaccttccacacgatgtggcacgtcacccgcggggccgtgctgatgcaccggggcaagcgcatcgagcccagctgggccgacgtgaagaaggacctgatctcctacgggggcggctggaagctcgagggggagtggaaggagggcgaggaggtccaggtgctggccctggagcccgggaagaacccccgggccgtgcagaccaagcccggcctcttcaagaccaacacggggaccatcggcgcggtcagcctggacttctcccccggcaccagcgggtcccccatcgtggaccgcaagggcaaggtggtcgggctgtacggcaacggcgtggtgacccggagcggggcctacgtcagcgccatcgcccagacggagaagtccatcgaggacaaccccgagatcgaggacgacatcttccgcaagaagcggctcaccatcatggacctgcaccccggcgcggggaagaccaagcgctacctgcccgccatcgtgcgggaggccatcaagcgcggcctgcggaccctcatcctggccccgacgcgcgtggtcgccgcggagatggaggaggccctgcgcgggctccccatccggtaccagacccccgccatccgcgccgagcacaccggccgggagatcgtggacctgatgtgccacgccaccttcacgatgcgcctgctcagccccgtgcgggtcccgaactacaacctgatcatcatggacgaggcgcacttcaccgaccccgcctccatcgccgcccgcggctacatcagcacccgggtggagatgggggaggccgcgggcatcttcatgaccgccacgccgcccgggtcccgcgacccgttcccccagagcaacgcccccatcatggacgaggagcgggagatccccgagcgctcctggaacagcggccacgagtgggtgaccgacttcaaggggaagaccgtctggttcgtgccgtccatcaaggccggcaacgacatcgcggcctgcctgcggaagaacggcaagaaggtgatccagctcagccgcaagaccttcgactccgagtacgtcaagacgcggaccaacgactgggacttcgtggtgaccaccgacatcagcgagatgggggccaacttcaaggccgagcgcgtcatcgacccccggcgctgcatgaagcccgtgatcctgacggacggcgaggagcgggtgatcctggccgggcccatgccggtcacccactccagcgcggcccagcgccggggccgcatcgggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtggacgccatcgacggggagtaccgcctccggggcgaggcgcgcaagaccttcgtggacctgatgcggcgcggggacctgcccgtctggctcgcctaccgggtggccgccgagggcatcaactacgccgaccgccggtggtgcttcgacggggtgaagaacaaccagatcctggaggagaacgtcgaggtggagatctggacgaaggagggcgagcgcaagaagctgaagccgcggtggctcgacgcgcgcatctacagcgaccccctggccctgaaggagttcaaggagttcgccgccggccggaagtccctcaccctgaacctgatcaccgagatggggcgcctccccaccttcatgacgcagaaggcgcgggacgccctggacaacctggccgtgctccacaccgccgaggccggcgggcgcgcgtacaaccacgccctgagcgagctgcccgagaccctcgagaccctgctgctcctgacgctgctcgccaccgtcaccggcggcatcttcctgttcctgatgtccgggaagggcgtggggaagatgaccctcggcatgtgctgcatcatcaccgccagcatcctgctgtggtacgcccagatccagccgcactggatcgcggccagcatcatcctcgagttcttcctgatcgtcctgctcatccccgagcccgagaagcagcggacgccccaggacaaccagctgacctacgtggtgatcgccatcctgaccgtcgtggccgccaccatggcgaacgagatggggttcctcgagaagacgaagaaggacctgggcctgggctccatcgccacccaggagccggagagcaacatcctcgacatcgacctgcgccccgcctccgcctggaccctgtacgccgtggcgaccacgttcgtcacccccatgctccggcacagcatcgagaactccagcgtgaacgtgtccctgaccgccatcgccaaccaggccaccgtcctgatggggctcggcaaggggtggcccctgagcaagatggacatcggcgtgccgctgctcgcgatcgggtgctactcccaggtgaaccccgtcacgctgaccgccgccctgctcctgctggtggcccactacgccatcatcggccccggcctccaggcgaaggccacccgcgaggcccagaagcgggccgccgcggggatcatgaagaaccccaccgtggacggcatcacggtcatcgacctggacccgatcccctacgaccccaagttcgagaagcagctggggcaggtcatgctcctgatcctgtgcgtgacccaggtcctcatgatgcgcaccacctgggccctgtgcgaggccctgacgctcgccaccggccccatcagcaccctgtgggaggggaacccgggccgcttctggaacaccacgatcgccgtgtccatggcgaacatcttccggggcagctacctggccggggccggcctcctgttctccatcatgaagaacaccaccaacacccgccgggggacgggcaacatcggcgagaccctgggggagaagtggaagtcccgcctcaacgccctgggcaagtccgagttccagatctacaagaagtccgggatccaggaggtggaccggaccctggcgaaggagggcatcaagcgcggggagaccgaccaccacgccgtctcccggggcagcgccaagctccgctggttcgtggagcggaacatggtgacgcccgagggcaaggtcgtggacctggggtgcggccgcgggggctggtcctactactgcgggggcctgaagaacgtgaaggaggtcaagggcctcaccaagggcgggcccgggcacgaggagcccatcccgatgagcacctacggctggaacctggtgcggctgcagagcggggtggacgtcttcttcacgccgcccgagaagtgcgacacgctcctgtgcgacatcggcgagtccagccccaacccgaccatcgaggccggccgcaccctgcgggtgctctccctggtggagaactggctgaacaacgacacccagttctgcatcaaggtcctcaacccctacatgcccagcgtgatcgagaagatggagaccctgcagcgcaagtacgggggcgccctggtgcggaacccgctgtcccgcaacagcacgcacgagatgtactgggtctccaacgcgaccgggaacatcgtgagctccgtgaacatgatcagccggatgctcatcaaccgcttcaccatgaagcacaagaaggccacctacgagctggacgtcgacctgggctccgggacgcggaacatcggcatcgagagcgagatccccaacctcgacatcatcggcaagcgcatcgagaagatcaagcaggagcacgagacctcctggcactacgaccaggaccacccctacaagacctgggcctaccacgggagctacgagaccaagcagacgggctccgccagctccatggtgaacggggtggtccgcctgctgaccaagccctgggacgtggtgccgatggtcacccagatggccatgaccgacacgacccccttcggccagcagcgggtgttcaaggagaaggtggacacccgcacccaggagcccaaggagggcacgaagaagctcatgaagatcaccgcggagtggctgtggaaggagctggggaagaagaagacgccccggatgtgcacccgcgaggagttcacgcggaaggtccgcagcaacgccgccctcggcgccatcttcaccgacgagaacaagtggaagtccgcccgggaggcggtggaggacagccgcttctgggagctggtggacaaggagcggaacctgcacctcgaggggaagtgcgagacctgcgtctacaacatgatgggcaagcgcgagaagaagctgggggagttcggcaaggccaagggcagccgggccatctggtacatgtggctgggggcccgcttcctcgagttcgaggcgctgggcttcctgaacgaggaccactggttctcccgggagaacagcctctccggggtggagggcgaggggctgcacaagctgggctacatcctccgcgacgtcggcaagaaggagggcggggccatgtacgccgacgacaccgccgggtgggacacgcggatcaccctggaggacctgaagaacgaggagatggtgaccaaccacatggagggcgagcacaagaagctcgccgaggcgatcttcaagctgacctaccagaacaaggtggtccgcgtgcagcggccgacgccccgcgggaccgtgatggacatcatcagccggcgcgaccagcggggctccggccaggtcgggacctacggcctgaacaccttcacgaacatggaggcccagctcatccgccagatggagggggagggcatcttcaagagcatccagcacctgaccgtgaccgaggagatcgccgtgcagaactggctggcccgcgtcggccgggagcgcctctcccggatggccatcagcggggacgactgcgtggtgaagcccctggacgaccgcttcgcgtccgccctgaccgccctcaacgacatgggcaaggtccggaaggacatccagcagtgggagcccagccgcgggtggaacgactggacccaggtgccgttctgctcccaccacttccacgagctgatcatgaaggacggccgggtgctggtcgtgccctgccgcaaccaggacgagctcatcgggcgggcccgcatcagccagggcgccggctggtccctgaaggagaccgcgtgcctgggcaagagctacgcccagatgtggtccctcatgtacttccaccggcgcgacctgcggctggccgccaacgccatctgcagcgcggtgccctcccactgggtccccaccagccgcaccacctggagcatccacgccaagcacgagtggatgacgaccgaggacatgctcaccgtgtggaaccgggtgtggatccaggagaacccgtggatggaggacaagacccccgtcgagtcctgggaggaggtgccctacctgggcaagcgcgaggaccagtggtgcgggagcctgatcggcctcacgtcccggaccacctgggccaagaacatccagaccgccatcaaccaggtgcgcagcctgatcgggaacgaggagtacacggactacatgccctccatgaagcggttccgccgcgaggaggaggaggcgggcgtcctgtggtga

SEQ ID NO: 9159 - RNA, 9876 nt, synthetic construct
  misc_feature 1..9876: note = derived and/or modified CDS sequence (opt1) from DENV-2__FJ639698__SS-prME
  source 1..9876: mol_type = other RNA
accgcgggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgcccagcggatcgagacctggatcctgcgccaccccggcttcaccatcatggcggccatcctggcctacaccatcgggaccacgcacttccagcgggccctcatcttcatcctgctgaccgcggtggcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaaggagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcagctgcaagaagaacatggagggcaagatcgtccagcccgagaacctggagtacaccatcgtgatcacgccccactccggggaggagcacgccgtgggcaacgacacggggaagcacggcaaggagatcaagatcaccccgcagagctccatcaccgaggccgagctgaccgggtacggcaccgtcacgatggagtgcagcccccgcaccggcctcgacttcaacgagatggtgctgctgcagatggaggacaaggcctggctcgtgcaccggcagtggttcctggacctgcccctcccctggctgccgggggcggacacccagggctccaactggatccagaaggagaccctggtcacgttcaagaacccccacgccaagaagcaggacgtggtggtcctcgggagccaggagggcgccatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgcggagacccagcacgggaccatcgtcatccgcgtgcagtacgagggcgacggcagcccctgcaagatccccttcgagatcatggacctggagaagcggcacgtgctcgggcgcctgatcacggtcaacccgatcatcaccgagaaggactcccccgtgaacatcgaggccgagccgcccttcggcgacagctacatcatcatcggggtggagccgggccagctgaagctcaactggttcaagaaggggtccagcatcggccagatgttcgagaccaccatgcgcggcgccaagcggatggccatcctgggggacacggcctgggacttcggctccctcggcggggtcttcaccagcatcgggaaggcgctccaccaggtgttcggggccatctacggcgccgccttctccggggtgagctggaccatgaagatcctgatcggcgtcatcatcacctggatcgggatgaactcccgcagcacgtccctgagcgtgtccctggtgctcgtcggcgtgatcaccctgtacctgggggcgatggtgcaggccgacagcggctgcgtcgtgtcctggaagaacaaggagctcaagtgcggcagcgggatcttcatcaccgacaacgtgcacacctggacggagcagtacaagttccagcccgagagcccctccaagctggccagcgccatccagaaggcccacgaggagggcatctgcgggatccggtccgtcacccgcctggagaacctcatgtggaagcagatcacccccgagctgaaccacatcctgagcgagaacgaggtgaagctcaccatcatgacgggcgacatcaaggggatcatgcaggcgggcaagcggtccctgcgcccgcagcccaccgagctgaagtacagctggaagacctggggcaaggccaagatgctctccaccgagagccacaaccagacgttcctgatcgacgggcccgagaccgccgagtgcccgaacaccaaccgggcctggaactccctggaggtggaggactacggcttcggggtcttcaccacgaacatctggctcaagctgaaggagaagcaggacgtgttctgcgaccccaagctgatgagcgccgcgatcaaggacaaccgcgccgtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaaggggttcgcgggcccggtgtcccagcacaactaccggcccgggtactacacccagaccgccggcccctggcacctcgggaagctggagatggacttcgacttctgcgagggcacgaccgtcgtggtgaccgaggactgcggcaaccgcgggcccagcctgcggaccacgaccgccagcggcaagctcatcaccgagtggtgctgccgctcctgcaccctgccgcccctgcggtaccgcggggaggacggctgctggtacgggatggagatccggcccctcaaggagaaggaggagaacctggtcaacagcctggtgacggccggccacggccagatcgacaacttctccctcggggtgctgggcatggcgctgttcctcgaggagatgctgcgcacccgggtcgggaccaagcacgccatcctgctcgtggccgtgagcttcgtcaccctgatcacgggcaacatgtccttccgcgacctggggcgggtgatggtgatggtcggcgccaccatgaccgacgacatcggcatgggggtgacctacctcgccctgctggcggccttcaaggtgcgccccacgttcagcgccggcctcctgctgcgcaagctcacctccaaggagctgatgatggccaccatcgggatcgccctgctcagccagtccaccatcccggagacgatcctggagctgaccgacgcgctcgccctgggcatgatggtcctgaagatcgtgcggaacatggagaagtaccagctcgccgtgaccatcatggccatcagctgcgtccccaacgccgtgatcctgcagaacgcgtggaaggtgtcctgcaccatcctggccgccgtcagcgtgagccccctcctgctgacgagctcccagcagaaggccgactggatccccctcgcgctgaccatcaagggcctgaacccgaccgccatcttcctcaccacgctgagccgcacctccaagaagcggagctggcccctgaacgaggccatcatggccgtggggatggtctccatcctcgccagcagcctgctgaagaacgacatccccatgaccggccccctcgtggccgggggcctgctgaccgtctgctacgtgctcacggggcgctccgccgacctggagctggagcgggccaccgacgtgaagtgggaggaccaggccgagatcagcggctccagcccgatcctctccatcaccatcagcgaggacggctccatgagcatcaagaacgaggaggaggagcagaccctgacgatcctgatccgcaccgggctcctggtcatctccggcctgttccccgtgagcatccccatcaccgccgcggcctggtacctctgggaggtgaagaagcagcgggccggggtcctgtgggacgtgccctccccgccgcccgtgggcaaggccgagctggaggacggggcctaccgcatcaagcagaagggcatcctcggctacagccagatcggggcgggcgtctacaaggaggggaccttccacaccatgtggcacgtgacgcggggcgccgtgctgatgcaccgcgggaagcggatcgagccgtcctgggccgacgtcaagaaggacctgatcagctacggcggcgggtggaagctcgagggcgagtggaaggagggggaggaggtccaggtgctggccctggagcccggcaagaacccccgcgccgtccagaccaagcccggcctcttcaagaccaacaccggcacgatcggcgcggtgtccctggacttcagcccggggacctccggcagccccatcgtggaccggaaggggaaggtcgtgggcctgtacggcaacggggtggtcacccgctccggcgcctacgtgagcgccatcgcccagaccgagaagtccatcgaggacaaccccgagatcgaggacgacatcttccggaagaagcgcctcacgatcatggacctgcaccccggggcgggcaagaccaagcggtacctgccggccatcgtgcgcgaggccatcaagcgggggctgcgcaccctcatcctggcccccacccgggtcgtggccgcggagatggaggaggccctgcgcggcctccccatccgctaccagacgcccgccatccgggccgagcacaccggccgcgagatcgtggacctgatgtgccacgccaccttcaccatgcggctgctctccccggtccgcgtgcccaactacaacctgatcatcatggacgaggcgcacttcacggaccccgccagcatcgccgcccgggggtacatctccacccgcgtggagatgggcgaggccgcggggatcttcatgaccgccacgccgcccggcagccgggaccccttcccccagtccaacgcccccatcatggacgaggagcgcgagatccccgagcggagctggaactccgggcacgagtgggtcacggacttcaagggcaagaccgtgtggttcgtgcccagcatcaaggccggcaacgacatcgcggcctgcctgcgcaagaacgggaagaaggtcatccagctctcccggaagaccttcgacagcgagtacgtgaagacccgcacgaacgactgggacttcgtggtcaccaccgacatctccgagatgggcgccaacttcaaggccgagcgggtgatcgacccccgccggtgcatgaagcccgtgatcctgaccgacggggaggagcgcgtcatcctggccggcccgatgcccgtgacgcacagctccgcggcccagcggcgcgggcggatcggccgcaaccccaagaacgagaacgaccagtacatctacatgggcgagcccctcgagaacgacgaggactgcgcccactggaaggaggccaagatgctgctggacaacatcaacaccccggaggggatcatccccagcatgttcgagcccgagcgcgagaaggtggacgccatcgacggcgagtaccggctccgcggggaggcgcggaagaccttcgtcgacctgatgcgccggggcgacctgccggtgtggctcgcctaccgcgtggccgccgaggggatcaactacgccgaccggcgctggtgcttcgacggcgtcaagaacaaccagatcctggaggagaacgtggaggtggagatctggaccaaggagggcgagcggaagaagctgaagccccgctggctcgacgcgcggatctactccgaccccctggccctgaaggagttcaaggagttcgccgccgggcgcaagagcctcacgctgaacctgatcaccgagatgggccggctccccaccttcatgacccagaaggcgcgcgacgccctggacaacctggccgtcctccacacggccgaggtcgggggccgggcctacaaccacgcgctgtccgagctgccggagaccctcgagaccctgctgctcctgaccctgctcgccacggtgaccggcgggatcttcctgttcctgatgagcggcaagggggtcggcaagatgaccctcgggatgtgctgcatcatcaccgcctccatcctgctgtggtacgcccagatccagccccactggatcgccgcgagcatcatcctcgagttcttcctgatcgtgctgctcatccccgagcccgagaagcagcgcaccccgcaggacaaccagctgacgtacgtcgtgatcgccatcctgaccgtggtcgccgccaccatggccaacgagatgggcttcctcgagaagaccaagaaggacctgggcctggggagcatcgcgacgcaggagcccgagtccaacatcctcgacatcgacctgcggcccgccagcgcctggaccctgtacgccgtggccaccaccttcgtgacgcccatgctccgccactccatcgagaacagctccgtcaacgtgagcctgaccgcgatcgccaaccaggccaccgtgctgatgggcctcgggaagggctggccgctgtccaagatggacatcggggtccccctgctcgccatcggctgctacagccaggtgaaccccatcaccctgacggcggccctgctcctgctggtggcccactacgccatcatcggccccgggctccaggccaaggcgacccgggaggcccagaagcgcgccgccgccggcatcatgaagaacccgaccgtcgacgggatcaccgtgatcgacctggaccccatcccctacgaccccaagttcgagaagcagctgggccaggtgatgctcctgatcctgtgcgtcacccaggtgctcatgatgcggaccacctgggcgctgtgcgaggccctgaccctcgccacggggccgatctccaccctgtgggagggcaaccccggccgcttctggaacaccaccatcgccgtgagcatggccaacatcttccgcgggtcctacctggcgggcgccgggctcctgttcagcatcatgaagaacacgaccaacacccggcgcggcaccggcaacatcggggagacgctgggcgagaagtggaagtcccggctcaacgccctggggaagaacgagttccagatctacaagaagtccggcatccaggaggtcgaccgcaccctggccaaggaggggatcaagcggggcgagaccgaccaccacgcggtgtcccgcggcagcgccaagctccggtggttcgtggagcgcaacatggtcacccccgaggggaaggtggtggacctgggctgcgggcggggcgggtggtcctactactgcggcggcctgaagaacgtccgcgaggtgaaggggctcacgaagggcgggcccggccacgaggagccgatccccatgagcacctacgggtggaacctggtgcggctgcagtccggcgtcgacgtgttcttcacgccgcccgagaagtgcgacaccctcctgtgcgacatcggcgagagcagcccgaaccccacgatcgaggccgggcgcaccctgcgggtgctctccctggtcgagaactggctgaacaacgacacccagttctgcatcaaggtgctcaacccctacatgccgagcgtgatcgagaagatggagaccctgcagcgcaagtacggcggggccctggtccggaaccccctgtcccgcaacagcacccacgagatgtactgggtgtccaacgccacgggcaacatcgtgagctccgtcaacatgatcagccggatgctcatcaaccgcttcaccatgaagcacaagaaggcgacctacgagcccgacgtggacctggggtccggcacccggaacatcggcatcgagagcgagatccccaacctggacatcatcgggaagcgcatcgagaagatcaagcaggagcacgagacgtcctggcactacgaccaggaccacccgtacaagacctgggcctaccacggcagctacgagaccaagcagaccgggtccgccagctccatggtgaacggcgtcgtgcgcctcctgacgaagccctgggacgtggtccccatggtgacccagatggccatgaccgacaccacgcccttcggccagcagcgggtgttcaaggagaaggtcgacacccgcacccaggagccgaaggaggggaccaagaagctgatgaagatcacggccaagtggctctggaaggagctgggcaagaagaagacgccccggatctgcacccgcgaggagttcaccaagaaggtgcggagcaacgcggccctgggggccatcttcacggacgagaacaagtggaagtccgcccgcgaggccgtggaggacagccggttctgggagctcgtcgacaaggagcgcaacctgcacctggagggcaagtgcgagacctgcgtgtacaacatgatggggaagcgggagaagaagctcggcgagttcggcaaggcgaaggggtcccgcgccatctggtacatgtggctgggcgcccggttcctggagttcgaggccctcgggttcctgaacgaggaccactggttcagccgcgagaacagcctgtccggcgtggagggggagggcctccacaagctgggctacatcctgcgggacgtcagcaagaaggagggcggcgcgatgtacgccgacgacaccgccgggtgggacacccgcatcacgctcgaggacctgaagaacgaggagatggtgaccaaccacatggagggcgagcacaagaagctggccgaggccatcttcaagctcacctaccagaacaaggtcgtgcgggtgcagcgccccacgccccgggggacggtcatggacatcatctcccgccgggaccagcgcggcagcggccaggtggggacctacggcctgaacaccttcaccaacatggaggcgcagctgatccggcagatggagggggagggcatcttcaagtccatccagcacctcacggtgaccgaggaggtcgccgtgcagaactggctggcccgcgtgggccgcgagcggctgagccgcatggccatctccggggacgactgcgtcgtgaagccgctcgacgaccggttcgccagcgcgctgaccgccctgaacgacatgggcaaggtgcgcaaggacatccagcagtgggagccctcccgggggtggaacgactggacccaggtccccttctgcagccaccacttccacgagctcatcatgaaggacggccgcgtgctggtggtcccctgccggaaccaggacgagctgatcgggcgcgcccggatctcccagggcgccggctggagcctcaaggagacggcctgcctggggaagtcctacgcgcagatgtggagcctgatgtacttccaccgccgggacctccgcctggccgccaacgccatctgctccgccgtgccgagccactgggtgcccacctcccggaccacctggagcatccacgcgaagcacgagtggatgaccacggaggacatgctgaccgtctggaaccgcgtgtggatccaggagaacccctggatggaggacaagacccccgtggagagctgggaggaggtcccgtacctcggcaagcgggaggaccagtggtgcgggtccctgatcggcctgaccagccgcgccacgtgggccaagaacatccagaccgccatcaaccaggtgcggtccctcatcgggaacgaggagtacaccgactacatgcccagcatgaagcgcttccggcgcgaggaggaggaggcgggcgtgctgtggtga

SEQ ID NO: 9160 - RNA, 9876 nt, synthetic construct
  misc_feature 1..9876: note = derived and/or modified CDS sequence (opt1) from DENV-2__FJ639699__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgcccagcggatcgagacctggatcctgcgccaccccggcttcaccatcatggcggccatcctggcctacaccatcgggaccacccacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaaggagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcagctgcaagaagaacatggagggcaagatcgtccagcccgagaacctggagtacaccatcgtgatcacgccccactccggggaggagcacgccgtgggcaacgacacggggaagcacggcaaggagatcaagatcaccccgcagagctccatcaccgaggccgagctgaccgggtacggcaccgtcacgatggagtgcagcccccgcaccggcctcgacttcaacgagatggtgctgctgcagatggaggacaaggcctggctcgtgcaccggcagtggttcctggacctgcccctcccctggctgccgggggcggacacccagggctccaactggatccagaaggagaccctggtcacgttcaagaacccccacgccaagaagcaggacgtggtggtcctcgggagccaggagggcgccatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgcggagacccagcacgggaccatcgtcatccgcgtgcagtacgagggcgacggcagcccctgcaagatccccttcgagatcatggacctggagaagcggcacgtgctcgggcgcctgatcacggtcaacccgatcatcaccgagaaggactcccccgtgaacatcgaggccgagccgcccttcggcgacagctacatcatcatcggggtggagccgggccagctgaagctcaactggttcaagaaggggtccagcatcggccagatgttcgagaccaccatgcgcggcgccaagcggatggccatcctgggggacacggcctgggacttcggctccctcggcggggtcttcaccagcatcgggaaggcgctccaccaggtgttcggggccatctacggcgccgccttctccggggtgagctggaccatgaagatcctgatcggcgtcatcatcacctggatcgggatgaactcccgcagcacgtccctgagcgtgtccctggtgctcgtcggcgtgatcaccctgtacctgggggcgatggtgcaggccgacagcggctgcgtcgtgtcctggaagaacaaggagctcaagtgcggcagcgggatcttcatcaccgacaacgtgcacacctggacggagcagtacaagttccagcccgagagcccctccaagctggccagcgccatccagaaggcccacgaggagggcatctgcgggatccggtccgtcacccgcctggagaacctcatgtggaagcagatcacccccgagctgaaccacatcctgagcgagaacgaggtgaagctcaccatcatgacgggcgacatcaaggggatcatgcaggcgggcaagcggtccctgcgcccgcagcccaccgagctgaagtacagctggaagacctggggcaaggccaagatgctctccaccgagagccacaaccagacgttcctgatcgacgggcccgagaccgccgagtgcccgaacaccaaccgggcctggaactccctggaggtggaggactacggcttcggggtcttcaccacgaacatctggctcaagctgaaggagaagcaggacgtgttctgcgacagcaagctgatgtccgccgcgatcaaggacaaccgcgccgtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaaggggttcgcgggccccgtgagccagcacaactaccggccggggtactacacccagaccgccggcccctggcacctcgggaagctggagatggacttcgacttctgcgagggcacgaccgtcgtggtgaccgaggactgcggcaaccgcgggcccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtcaactccctggtgacggccggccacggccagatcgacaacttcagcctcggggtgctgggcatggcgctgttcctcgaggagatgctgcgcacccgggtcgggaccaagcacgccatcctgctcgtggccgtgtccttcgtcaccctgatcacgggcaacatgagcttccgcgacctggggcgggtgatggtgatggtcggcgccaccatgaccgacgacatcggcatgggggtgacctacctcgccctgctggcggccttcaaggtgcgccccacgttcgccgccggcctcctgctgcgcaagctcacctccaaggagctgatgatggccaccatcgggatcgcgctgctcagccagtccaccatccccgagacgatcctggagctgaccgacgccctcgccctgggcatgatgatcctgaagatcgtccggaacatggagaagtaccagctcgccgtgaccatcatggccatcagctgcgtgccgaacgcggtcatcctgcagaacgcctggaaggtgtcctgcaccatcctggccgccgtgagcgtcagccccctcctgctgacgagctcccagcagaaggcggactggatccccctcgccctgaccatcaagggcctgaaccccaccgccatcttcctcaccacgctgagccgcacctccaagaagcggagctggccgctgaacgaggccatcatggccgtggggatggtgtccatcctcgcgagcagcctgctgaagaacgacatccccatgaccggccccctcgtcgccgggggcctgctgaccgtgtgctacgtcctcacggggcgctccgccgacctggagctggagcgggccaccgacgtgaagtgggaggaccaggccgagatcagcggctccagccccatcctctccatcaccatcagcgaggacggctccatgagcatcaagaacgaggaggaggagcagaccctgacgatcctgatccgcaccgggctcctggtgatctccggcctgttcccggtcagcatccccatcaccgcggccgcctggtacctctgggaggtgaagaagcagcgggccggggtgctgtgggacgtccccagcccgccgcccgtgggcaaggccgagctggaggacggggcgtaccgcatcaagcagaagggcatcctcggctacagccagatcggggccggcgtgtacaaggaggggaccttccacaccatgtggcacgtcacgcggggcgccgtgctgatgcaccgcgggaagcggatcgagccctcctgggccgacgtgaagaaggacctgatcagctacggcggcgggtggaagctcgagggcgagtggaaggagggggaggaggtccaggtgctggccctggagcccggcaagaacccccgcgcggtgcagaccaagcccggcctcttcaagaccaacaccggcacgatcggcgccgtctccctggacttcagccccgggacctccggcagccccatcgtggaccggaaggggaaggtggtcggcctgtacggcaacggggtggtgacccgctccggcgcctacgtcagcgccatcgcgcagaccgagaagtccatcgaggacaaccccgagatcgaggacgacatcttccggaagaagcgcctcacgatcatggacctgcaccccggggccggcaagaccaagcggtacctgcccgccatcgtgcgcgaggccatcaagcgggggctgcgcaccctcatcctggccccgacccgggtggtcgcggccgagatggaggaggccctgcgcggcctccccatccgctaccagacgcccgccatccgggccgagcacaccggccgcgagatcgtggacctgatgtgccacgcgaccttcaccatgcggctgctctcccccgtgcgcgtcccgaactacaacctgatcatcatggacgaggcccacttcacggaccccgccagcatcgccgcccgggggtacatctccacccgcgtggagatgggcgaggcggccgggatcttcatgaccgccacgccgcccggcagccgggacccgttcccccagtccaacgcccccatcatggacgaggagcgcgagatccccgagcggagctggaactccgggcacgagtgggtgacggacttcaagggcaagaccgtctggttcgtgccgagcatcaaggcgggcaacgacatcgccgcctgcctgcgcaagaacgggaagaaggtgatccagctctcccggaagaccttcgacagcgagtacgtcaagacccgcacgaacgactgggacttcgtggtgaccaccgacatctccgagatgggcgccaacttcaaggccgagcgggtcatcgacccccgccggtgcatgaagcccgtgatcctgaccgacggggaggagcgcgtgatcctggcgggccccatgccggtcacgcacagctccgccgcccagcggcgcgggcggatcggccgcaaccccaagaacgagaacgaccagtacatctacatgggcgagcccctcgagaacgacgaggactgcgcccactggaaggaggccaagatgctgctggacaacatcaacacccccgaggggatcatcccgagcatgttcgagcccgagcgcgagaaggtggacgcgatcgacggcgagtaccggctccgcggggaggcccggaagaccttcgtggacctgatgcgccggggcgacctgcccgtctggctcgcctaccgcgtggccgccgaggggatcaactacgcggaccggcgctggtgcttcgacggcgtgaagaacaaccagatcctggaggagaacgtcgaggtggagatctggaccaaggagggcgagcggaagaagctgaagccgcgctggctcgacgcccggatctactccgaccccctggccctgaaggagttcaaggagttcgccgcggggcgcaagagcctcacgctgaacctgatcaccgagatgggccggctccccaccttcatgacccagaaggcccgcgacgccctggacaacctggccgtgctccacacggccgaggtcgggggccgggcgtacaaccacgccctgtccgagctgcccgagaccctcgagaccctgctgctcctgaccctgctcgccacggtgaccggcgggatcttcctgttcctgatgagcggcaagggggtgggcaagatgaccctcgggatgtgctgcatcatcaccgcctccatcctgctgtggtacgcccagatccagccgcactggatcgcggccagcatcatcctcgagttcttcctgatcgtcctgctcatccccgagcccgagaagcagcgcacgccccaggacaaccagctgacgtacgtggtcatcgccatcctgaccgtggtggccgccaccatggcgaacgagatgggcttcctcgagaagaccaagaaggacctgggcctggggagcatcgccacgcaggagccggagtccaacatcctcgacatcgacctgcggcccgccagcgcctggaccctgtacgccgtcgcgaccaccttcgtgacgcccatgctccgccactccatcgagaacagctccgtgaacgtcagcctgaccgccatcgccaaccaggccaccgtgctgatgggcctcgggaagggctggcccctgtccaagatggacatcggggtgccgctgctcgcgatcggctgctacagccaggtcaaccccatcaccctgacggccgccctgctcctgctggtggcccactacgccatcatcggccccgggctccaggcgaaggccacccgggaggcccagaagcgcgccgccgcgggcatcatgaagaaccccaccgtggacgggatcaccgtcatcgacctggacccgatcccctacgaccccaagttcgagaagcagctgggccaggtgatgctcctgatcctgtgcgtgacgcaggtcctcatgatgcggaccacctgggccctgtgcgaggccctgaccctcgccacggggcccatctccaccctgtgggagggcaacccgggccgcttctggaacaccaccatcgccgtgagcatggcgaacatcttccgcgggtcctacctggccggcgccgggctcctgttcagcatcatgaagaacacgaccaacacccggcgcggcaccggcaacatcggggagacgctgggcgagaagtggaagtcccggctcaacgccctggggaagaacgagttccagatctacaagaagtccggcatccaggaggtggaccgcaccctggcgaaggaggggatcaagcggggcgagaccgaccaccacgccgtctcccgcggcagcgccaagctccggtggttcgtggagcgcaacatggtgacccccgaggggaaggtcgtggacctgggctgcgggcggggcgggtggtcctactactgcggcggcctgaagaacgtgcgcgaggtcaaggggctcacgaagggcgggcccggccacgaggagcccatcccgatgagcacctacgggtggaacctggtgcggctgcagtccggcgtggacgtcttcttcacgccgcccgagaagtgcgacaccctcctgtgcgacatcggcgagagcagccccaacccgacgatcgaggccgggcgcaccctgcgggtgctctccctggtggagaactggctgaacaacgacacccagttctgcatcaaggtcctcaacccctacatgcccagcgtgatcgagaagatggagaccctgcagcgcaagtacggcggggccctggtgcggaacccgctgtcccgcaacagcacccacgagatgtactgggtctccaacgcgacgggcaacatcgtgagctccgtgaacatgatcagccggatgctcatcaaccgcttcaccatgaagcacaagaaggccacctacgagcccgacgtcgacctggggtccggcacccggaacatcggcatcgagagcgagatccccaacctggacatcatcgggaagcgcatcgagaagatcaagcaggagcacgagacgtcctggcactacgaccaggaccacccctacaagacctgggcctaccacggcagctacgagaccaagcagaccgggtccgccagctccatggtgaacggcgtggtccgcctcctgacgaagccgtgggacgtggtgcccatggtcacccagatggccatgaccgacaccacgcccttcggccagcagcgggtgttcaaggagaaggtggacacccgcacccaggagcccaaggaggggaccaagaagctgatgaagatcacggcgaagtggctctggaaggagctgggcaagaagaagaccccgcggatctgcacccgcgaggagttcaccaagaaggtccggagcaacgccgccctgggggccatcttcacggacgagaacaagtggaagtccgcccgcgaggcggtggaggacagccggttctgggagctcgtggacaaggagcgcaacctgcacctggagggcaagtgcgagacctgcgtctacaacatgatggggaagcgggagaagaagctcggcgagttcggcaaggccaaggggtcccgcgccatctggtacatgtggctgggcgcccggttcctggagttcgaggcgctcgggttcctgaacgaggaccactggttcagccgcgagaacagcctgtccggcgtggagggggagggcctccacaagctgggctacatcctgcgggacgtgagcaagaaggagggcggcgccatgtacgccgacgacaccgccgggtgggacacccgcatcacgctcgaggacctgaagaacgaggagatggtcaccaaccacatggagggcgagcacaagaagctggccgaggcgatcttcaagctcacctaccagaacaaggtggtccgggtgcagcgccccacgccccgggggacggtgatggacatcatctcccgccgggaccagcgcggcagcggccaggtcgggacctacggcctgaacaccttcaccaacatggaggcccagctgatccggcagatggagggggagggcatcttcaagtccatccagtacctcacggtgaccgaggaggtggccgtccagaactggctggcccgcgtgggccgcgagcggctgagccgcatggccatctccggggacgactgcgtggtcaagcccctcgacgaccggttcgcgagcgccctgaccgccctgaacgacatgggcaaggtgcgcaaggacatccagcagtgggagccgtcccgggggtggaacgactggacccaggtgcccttctgcagccaccacttccacgagctcatcatgaaggacggccgcgtcctggtggtgccctgccggaaccaggacgagctgatcgggcgcgcccggatctcccagggcgccggctggagcctcaaggagacggcgtgcctggggaagtcctacgcccagatgtggagcctgatgtacttccaccgccgggacctccgcctggccgccaacgccatctgctccgcggtccccagccactgggtgccgacctcccggaccacctggagcatccacgccaagcacgagtggatgaccacggaggacatgctgaccgtgtggaaccgcgtctggatccaggagaacccctggatggaggacaagacccccgtggagagctgggaggaggtgccctacctcggcaagcgggaggaccagtggtgcgggtccctgatcggcctgaccagccgcgccacgtgggccaagaacatccagaccgcgatcaaccaggtccggtccctcatcgggaacgaggagtacaccgactacatgccgagcatgaagcgcttccggcgcgaggaggaggaggccggcgtgctgtggtga

SEQ ID NO: 9161 - RNA, 9876 nt, synthetic construct
  misc_feature 1..9876: note = derived and/or modified CDS sequence (opt1) from DENV-2__FJ639700__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgcccagcggatcgagacctggatcctgcgccaccccggcttcaccatcatggcggccatcctggcctacaccatcgggaccacgcacttccagcgggccctcatcttcatcctgctgaccgcggtcgcccccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaaggagcccgccaccctccgcaagtactgcatcgaggcgaagctgacgaacaccaccaccgagtcccggtgcccgacgcagggcgagcccagcctgaacgaggagcaggacaagcgcttcgtctgcaagcactccatggtggaccggggctgggggaacggctgcgggctgttcggcaagggcgggatcgtgacctgcgccatgttcagctgcaagaagaacatggagggcaagatcgtccagcccgagaacctggagtacaccatcgtgatcacgccccactccggggaggagcacgccgtgggcaacgacacggggaagcacggcaaggagatcaagatcaccccgcagagctccatcaccgaggccgagctgaccgggtacggcaccgtcacgatggagtgcagcccccgcaccggcctcgacttcaacgagatggtgctgctgcagatggaggacaaggcctggctcgtgcaccggcagtggttcctggacctgcccctcccctggctgccgggggcggacacccagggctccaactggatccagaaggagaccctggtcacgttcaagaacccccacgccaagaagcaggacgtggtggtcctcgggagccaggagggcgccatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgcggagacccagcacgggaccatcgtcatccgcgtgcagtacgagggcgacggcagcccctgcaagatccccttcgagatcatggacctggagaagcggcacgtgctcgggcgcctgatcacggtcaacccgatcatcaccgagaaggactcccccgtgaacatcgaggccgagccgcccttcggcgacagctacatcatcatcggggtggagccgggccagctgaagctcaactggttcaagaaggggtccagcatcggccagatgttcgagaccaccatgcgcggcgccaagcggatggccatcctgggggacacggcctgggacttcggctccctcggcggggtcttcaccagcatcgggaaggcgctccaccaggtgttcggggccatctacggcgccgccttctccggggtgagctggaccatgaagatcctgatcggcgtcatcatcacctggatcgggatgaactcccgcagcacgtccctgagcgtgtccctggtgctcgtcggcgtgatcaccctgtacctgggggcgatggtgcaggccgacagcggctgcgtcgtgtcctggaagaacaaggagctcaagtgcggcagcgggatcttcatcaccgacaacgtgcacacctggacggagcagtacaagttccagcccgagagcccctccaagctggccagcgccatccagaaggcccacgaggagggcatctgcgggatccggtccgtcacccgcctggagaacctcatgtggaagcagatcacccccgagctgaaccacatcctgagcgagaacgaggcgaagctcaccatcatgacgggcgacatcaaggggatcatgcaggccggcaagcggtccctgcgcccgcagcccaccgagctgaagtacagctggaagacctggggcaaggccaagatgctctccaccgagagccacaaccagacgttcctgatcgacgggcccgagaccgccgagtgcccgaacaccaaccgggcctggaactccctggaggtggaggactacggcttcggggtgttcaccacgaacatctggctcaagctgaaggagaagcaggacgtcttctgcgacagcaagctgatgtccgcggccatcaaggacaaccgcgccgtgcacgccgacatgggctactggatcgagagcgccctcaacgacacctggaagatggagaaggcgtccttcatcgaggtgaagtcctgccactggcccaagtcccacaccctgtggagcaacggcgtcctggagtccgagatgatcatccccaaggggttcgccggccccgtgagccagcacaactaccggccggggtaccacacccagaccgccggcccctggcacctcgggaagctggagatggacttcgacttctgcgagggcacgaccgtggtcgtgaccgaggactgcggcaaccgcgggcccagcctgcggaccacgaccgcctccggcaagctcatcaccgagtggtgctgccgcagctgcaccctgcccccgctgcggtaccgcggggaggacggctgctggtacgggatggagatccggcccctcaaggagaaggaggagaacctggtgaactccctggtcacggcgggccacggccagatcgacaacttcagcctcggggtgctgggcatggccctgttcctcgaggagatgctgcgcacccgggtggggaccaagcacgccatcctgctcgtcgccgtgtccttcgtgaccctgatcacgggcaacatgagcttccgcgacctggggcgggtcatggtgatggtgggcgccaccatgaccgacgacatcggcatgggggtcacctacctcgcgctgctggccgccttcaaggtgcgccccacgttcgccgccggcctcctgctgcgcaagctcacctccaaggagctgatgatggcgaccatcgggatcgccctgctcagccagtccaccatccccgagacgatcctggagctgaccgacgccctcgccctgggcatgatgatcctgaagatcgtgcggaacatggagaagtaccagctcgccgtcaccatcatggcgatcagctgcgtgccgaacgccgtgatcctgcagaacgcctggaaggtctcctgcaccatcctggccgcggtgagcgtgagccccctcctgctgacgagctcccagcagaaggccgactggatccccctcgccctgaccatcaagggcctgaaccccaccgccatcttcctcaccacgctgagccgcacctccaagaagcggagctggccgctgaacgaggccatcatggcggtcgggatggtgtccatcctcgccagcagcctgctgaagaacgacatccccatgaccggccccctcgtggccgggggcctgctgaccgtctgctacgtgctcacggggcgctccgccgacctggagctggagcgggccaccgacgtcaagtgggaggaccaggcggagatcagcggctccagccccatcctctccatcaccatcagcgaggacggctccatgagcatcaagaacgaggaggaggagcagaccctgacgatcctgatccgcaccgggctcctggtgatctccggcctgttcccggtgagcatccccatcaccgccgccgcctggtacctctgggaggtcaagaagcagcgggccggggtgctgtgggacgtgcccagcccgccgcccgtcggcaaggcggagctggaggacggggcctaccgcatcaagcagaagggcatcctcggctacagccagatcggggccggcgtgtacaaggaggggaccttccacaccatgtggcacgtgacgcggggcgccgtcctgatgcaccgcgggaagcggatcgagccctcctgggccgacgtgaagaaggacctgatcagctacggcggcgggtggaagctcgagggcgagtggaaggagggggaggaggtgcaggtcctggcgctggagcccggcaagaacccccgcgccgtgcagaccaagcccggcctcttcaagaccaacaccggcacgatcggcgccgtgtccctggacttcagccccgggacctccggcagccccatcgtcgaccggaaggggaaggtggtgggcctgtacggcaacggggtcgtgacccgctccggcgcctacgtgagcgcgatcgcccagaccgagaagtccatcgaggacaaccccgagatcgaggacgacatcttccggaagaagcgcctcacgatcatggacctgcaccccggggccggcaagaccaagcggtacctgcccgccatcgtccgcgaggccatcaagcgggggctgcgcaccctcatcctggcgccgacccgggtggtggccgccgagatggaggaggccctgcgcggcctccccatccgctaccagacgcccgccatccgggcggagcacaccggccgcgagatcgtcgacctgatgtgccacgccaccttcaccatgcggctgctctcccccgtgcgcgtgccgaactacaacctgatcatcatggacgaggcccacttcacggaccccgccagcatcgccgcgcgggggtacatctccacccgcgtcgagatgggcgaggccgccgggatcttcatgaccgccacgccgcccggcagccgggacccgttcccccagtccaacgcgcccatcatggacgaggagcgcgagatccccgagcggagctggaactccgggcacgagtgggtgacggacttcaagggcaagaccgtgtggttcgtcccgagcatcaaggccggcaacgacatcgccgcctgcctgcgcaagaacgggaagaaggtgatccagctctcccggaagaccttcgacagcgagtacgtgaagacccgcacgaacgactgggacttcgtcgtgaccaccgacatctccgagatgggcgccaacttcaaggcggagcgggtgatcgacccccgccggtgcatgaagcccgtcatcctgaccgacggggaggagcgcgtgatcctggccggccccatgccggtgacgcacagctccgccgcccagcggcgcgggcggatcggccgcaaccccaagaacgagaacgaccagtacatctacatgggcgagcccctcgagaacgacgaggactgcgcccactggaaggaggcgaagatgctgctggacaacatcaacacccccgaggggatcatcccgagcatgttcgagcccgagcgcgagaaggtcgacgccatcgacggcgagtaccggctccgcggggaggcccggaagaccttcgtggacctgatgcgccggggcgacctgcccgtgtggctcgcctaccgcgtcgccgcggaggggatcaactacgccgaccggcgctggtgcttcgacggcgtgaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccgggcgcaagagcctcacgctgaacctgatcaccgagatgggccggctccccaccttcatgacccagaaggcccgcgacgccctggacaacctggccgtgctccacacggcggaggtcgggggccgggcctacaaccacgccctgtccgagctgcccgagaccctcgagaccctgctgctcctgaccctgctcgccacggtcaccggcgggatcttcctgttcctgatgagcggcaagggggtgggcaagatgaccctcgggatgtgctgcatcatcaccgcctccatcctgctgtggtacgcgcagatccagccgcactggatcgccgccagcatcatcctcgagttcttcctgatcgtgctgctcatccccgagcccgagaagcagcgcacgccccaggacaaccagctgacgtacgtcgtgatcgccatcctgaccgtcgtggccgcgaccatggccaacgagatgggcttcctcgagaagaccaagaaggacctgggcctggggagcatcgccacgcaggagccggagtccaacatcctcgacatcgacctgcggcccgccagcgcctggaccctgtacgcggtggccaccaccttcgtcacgcccatgctccgccactccatcgagaacagctccgtgaacgtgagcctgaccgccatcgccaaccaggcgaccgtcctgatgggcctcgggaagggctggcccctgtccaagatggacatcggggtgccgctgctcgccatcggctgctacagccaggtgaaccccatcaccctgacggccgccctgctcctgctggtcgcccactacgcgatcatcggccccgggctccaggccaaggccacccgggaggcccagaagcgcgccgcggccggcatcatgaagaaccccaccgtggacgggatcaccgtgatcgacctggacccgatcccctacgaccccaagttcgagaagcagctgggccaggtcatgctcctgatcctgtgcgtgacccaggtgctcatgatgcggaccacctgggccctgtgcgaggccctgaccctcgccacggggcccatctccaccctgtgggagggcaacccgggccgcttctggaacaccaccatcgcggtcagcatggccaacatcttccgcgggtcctacctggccggcgccgggctcctgttcagcatcatgaagaacacgaccaacacccggcgcggcaccggcaacatcggggagacgctgggcgagaagtggaagtcccggctcaacgcgctggggaagaacgagttccagatctacaagaagtccggcatccaggaggtggaccgcaccctggccaaggaggggatcaagcggggcgagaccgaccaccacgccgtgtcccgcggcagcgccaagctccggtggttcgtcgagcgcaacatggtgacccccgaggggaaggtggtcgacctgggctgcgggcggggcgggtggtcctactactgcggcggcctgaagaacgtgcgcgaggtgaaggggctcacgaagggcgggcccggccacgaggagcccatcccgatgagcacctacgggtggaacctggtccggctgcagtccggcgtggacgtgttcttcacgccgcccgagaagtgcgacaccctcctgtgcgacatcggcgagagcagccccaacccgacgatcgaggccgggcgcaccctgcgggtcctctccctggtggagaactggctgaacaacgacacccagttctgcatcaaggtgctcaacccctacatgcccagcgtcatcgagaagatggagaccctgcagcgcaagtacggcggggcgctggtgcggaacccgctgtcccgcaacagcacccacgagatgtactgggtgtccaacgccacgggcaacatcgtcagctccgtgaacatgatcagccggatgctcatcaaccgcttcaccatgaagcacaagaaggccacctacgagcccgacgtggacctggggtccggcacccggaacatcggcatcgagagcgagatccccaacctggacatcatcgggaagcgcatcgagaagatcaagcaggagcacgagacgtcctggcactacgaccaggaccacccctacaagacctgggcctaccacggcagctacgagaccaagcagaccgggtccgccagctccatggtcaacggcgtggtgcgcctcctgacgaagccgtgggacgtcgtgcccatggtgacccagatggcgatgaccgacaccacgcccttcggccagcagcgggtcttcaaggagaaggtggacacccgcacccaggagcccaaggaggggaccaagaagctgatgaagatcacggccaagtggctctggaaggagctgggcaagaagaagaccccgcggatctgcacccgcgaggagttcaccaagaaggtgcggagcaacgccgccctgggggccatcttcacggacgagaacaagtggaagtccgcgcgcgaggccgtcgaggacagccggttctgggagctcgtggacaaggagcgcaacctgcacctggagggcaagtgcgagacctgcgtgtacaacatgatggggaagcgggagaagaagctcggcgagttcggcaaggccaaggggtcccgcgccatctggtacatgtggctgggcgcgcggttcctggagttcgaggccctcgggttcctgaacgaggaccactggttcagccgcgagaacagcctgtccggcgtcgagggggagggcctccacaagctgggctacatcctgcgggacgtgagcaagaaggagggcggcgccatgtacgccgacgacaccgccgggtgggacacccgcatcacgctcgaggacctgaagaacgaggagatggtgaccaaccacatggagggcgagcacaagaagctggcggaggccatcttcaagctcacctaccagaacaaggtcgtgcgggtccagcgccccacgccccgggggacggtgatggacatcatctcccgcaaggaccagcggggcagcggccaggtggggacctacggcctgaacaccttcaccaacatggaggcccagctgatccgccagatggagggggagggcatcttcaagtccatccagtacctcacggtcaccgaggaggtggccgtgcagaactggctggcccgggtcggccgcgagcgcctgagccggatggcgatctccggggacgactgcgtggtgaagcccctcgacgaccgcttcgccagcgccctgaccgccctgaacgacatgggcaaggtccggaaggacatccagcagtgggagccgtcccgcgggtggaacgactggacccaggtgcccttctgcagccaccacttccacgagctcatcatgaaggacggccgggtgctggtcgtgccctgccgcaaccaggacgagctgatcgggcgggcccgcatctcccagggcgcgggctggagcctcaaggagacggcctgcctggggaagtcctacgcccagatgtggagcctgatgtacttccaccggcgcgacctccggctggccgccaacgcgatctgctccgccgtgcccagccactgggtcccgacctcccgcaccacctggagcatccacgccaagcacgagtggatgaccacggaggacatgctgaccgtgtggaaccgggtgtggatccaggagaacccctggatggaggacaagacccccgtcgagagctgggaggaggtgccctacctcggcaagcgcgaggaccagtggtgcgggtccctgatcggcctgaccagccgggccacgtgggcgaagaacatccagaccgccatcaaccaggtgcgctccctcatcgggaacgaggagtacaccgactacatgccgagcatgaagcggttccgccgggaggaggaggaggccggcgtcctgtggtga

SEQ ID NO: 9162 - RNA, 9876 nt, synthetic construct
  misc_feature 1..9876: note = derived and/or modified CDS sequence (opt1) from DENV-2__GQ868620__SS-prME
  source 1..9876: mol_type = other RNA
agcgccggcatgatcatcatgctgatccccaccgtgatggccttccacctcaccacccgcaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctgttcaccggccacctgaagtgccggctgcgcatggacaagctccagctgaaggggatgagctactccatgtgcacgggcaagttcaaggtggtgaaggagatcgccgagacccagcacgggaccatcgtcatccgggtgcagtacgagggcgacggcagcccctgcaagatccccttcgagatcatggacctggagaagcgctacgtgctcgggcggctgatcaccgtcaacccgatcgtgacggagaaggactcccccgtgaacatcgaggcggagccgcccttcggcgacagctacatcatcatcggggtcgagccgggccagctgaagctcaactggttcaagaaggggtccagcatcggccagatgttcgagaccaccatgcgcggcgccaagcgcatggccatcctgggggacaccgcctgggacttcggctccctcggcggggtgttcacgagcatcgggaaggccctccaccaggtgttcggcgcgatctacggcgccgccttctccggggtcagctggaccatgaagatcctgatcggcgtgatcatcacctggatcgggatgaactcccggagcacctccctgagcgtgtccctggtcctcgtgggcatcgtgacgctgtacctgggggtcatggtgcaggccgacagcggctgcgtggtctcctggaagaacaaggagctcaagtgcggcagcgggatcttcatcaccgacaacgtgcacacctggaccgagcagtacaagttccagcccgagagcccctccaagctggcgagcgccatccagaaggcccaggaggagggcatctgcgggatccgctccgtgacgcggctggagaacctcatgtggaagcagatcacccccgagctgaaccacatcctggccgagaacgaggtcaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtggaggactacggcttcggggtgttcaccaccaacatctggctcaagctgaaggagaagcaggacgccttctgcgactccaagctgatgagcgccgcgatcaaggacaaccgggccgtccacgccgacatgggctactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgcggggcccgtcagccagcacaactaccgcccgggctaccacacccagatcgccgggccctggcacctgggcaagctggagatggacttcgacttctgcgacgggaccaccgtgatcgtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtcaactccctcgtgaccgccgggcacggccaggtggacaacttcagcctgggcgtcctggggatggccctgttcctggaggagatgctgcggacccgcgtgggcacgaagcacgccatcctcctggtggccgtctccttcgtgaccctgatcaccgggaacatgagcttcaaggacctcggccgggtggtcgtgatggtgggggccaccatgacggacgacatcggcatgggcgtcacctacctggccctgctcgcggccttcaaggtgcgccccaccttcgccgccgggctgctgctccggaagctgacctccaaggagctgatgatgacgaccatcggcatcgtgctcctgagccagtccaccatccccgagaccatcctggagctcacggacgccctggcgctggggatgatggtcctcaagatcgtgcgcaacatggagaagtaccagctggccgtgaccatcatggccatcctgtgcgtcccgaacgccgtgatcctccagaacgcctggaaggtcagctgcaccatcctggcggtggtgtccgtcagccccctgctcctgacctccagccagcagaagacggactggatccccctggccctcaccatcaagggcctgaaccccaccgccatcttcctgaccacgctctcccgcaccaacaagaagcggagctggccgctgaacgaggccatcatggcggtgggcatggtgtccatcctggccagctccctcctgaagaacgacatccccatgaccgggcccctggtcgccggcgggctcctgaccgtgtgctacgtgctgacgggccgcagcgccgacctcgagctggagcgggccaccgacgtcaagtgggaggaccaggcggagatctccgggagcagccccatcctgtccatcaccatcagcgaggacggctccatgagcatcaagaacgaggaggaggagcagaccctcacgatcctgatccgcaccggcctgctcgtgatctccgggctgttcccggtgagcatccccatcaccgccgccgcctggtacctgtgggaggtcaagaagcagcgggccggcgtgctctgggacgtgcccagcccgccgcccatggggaaggcggagctggaggacggcgcctaccgcatcaagcagaaggggatcctgggctacagccagatcggcgccggggtctacaaggagggcaccttccacaccatgtggcacgtgacgcgcggggcggtgctcatgcacaagggcaagcgcatcgagccctcctgggccgacgtcaagaaggacctgatcagctacgggggcggctggaagctggagggggagtggaaggagggcgaggaggtccaggtgctcgcgctggagcccgggaagaacccccgggtcgtgcagaccaagcccggcctgttcaagaccaacaccgggacgatcggcgccgtgtccctcgacttcagccccggcacctccgggagccccatcatcgacaagaagggcaaggtcgtggggctgtacggcaacggcgtggtcacccgctccggggcctacgtgagcgccatcgcccagaccgagaagtccatcgaggacaaccccgagatcgaggacgacatcttccggaagcgccggctgacgatcatggacctgcaccccggcgcggggaagaccaagcgctacctccccgccatcgtgcgggaggccatcaagcgcggcctgcggaccctgatcctcgccccgacccgcgtcgtggcggccgagatggaggaggccctgcgggggctgcccatccgctaccagacgcccgccatccgggccgagcacaccggccgcgagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggggaggcggccggcatcttcatgaccgccacgccgcccgggagccgcgacccgttcccccagtccaacgcccccatcatcgacgaggagcgggagatccccgagcgcagctggaactccggccacgagtgggtcacggacttcaaggggaagaccgtgtggttcgtgccgagcatcaaggccggcaacgacatcgcggcctgcctgcggaagaacggcaagaaggtcatccagctgtcccgcaagaccttcgacagcgagtacgtgaagacccggacgaacgactgggacttcgtggtcaccaccgacatctccgagatgggggccaacttcaaggccgagcgcgtgatcgacccccggcgctgcatgaagcccgtgatcctcaccgacggcgaggagcgggtcatcctggcggggcccatgccggtgacgcacagctccgccgcccagcgccggggccgcatcgggcggaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgcgagaaggtggacgcgatcgacggggagtaccggctgcgcggcgaggcccgcaagaccttcgtcgacctcatgcggcgcggggacctgcccgtgtggctggcctacaaggtggccgccgagggcatcaactacgcggaccggcgctggtgcttcgacgggatcaagaacaaccagatcctcgaggagaacgtcgaggtggagatctggaccaaggagggcgagcggaagaagctgaagccgcgctggctggacgcccggatctactccgaccccctcgccctgaaggagttcaaggagttcgccgccggccgcaagagcctgacgctcaacctgatcaccgagatggggcggctgcccaccttcatgacccagaagacgcgcgacgcgctcgacaacctggccgtcctgcacaccgccgaggccggcgggcgggcgtacaaccacgccctctccgagctgcccgagaccctggagaccctcctgctgctcacgctgctggccaccgtgaccggcggcatcttcctcttcctgatgagcgggcgcggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccaccatggcgaacgagatggggttcctggagaagacgaagaaggacctcggcctgggctccatcgccacccagcagccggagagcaacatcctggacatcgacctccgccccgcctccgcctggaccctgtacgccgtggcgaccacgttcgtgacccccatgctgcggcacagcatcgagaacagctccgtcaacgtgagcctcaccgccatcgccaaccaggccaccgtgctgatggggctgggcaaggggtggcccctctccaagatggacatcggcgtcccgctgctggccatcgggtgctacagccaggtgaaccccatcacgctcaccgcggccctgctgctcctgatcgcccactacgccatcatcggccccggcctgcaggcgaaggccacccgcgaggcccagaagcgggccgccgcggggatcatgaagaaccccaccgtggacggcatcacggtcatcgacctcgacccgatcccctacgaccccaagttcgagaagcagctgggccaggtgatgctgctcatcctgtgcgtgacccaggtcctgatgatgcgcaccacctgggccctctgcgaggccctgacgctggccaccggccccatctccaccctctgggaggggaacccgggccggttctggaacaccacgatcgccgtgagcatggcgaacatcttccgcggctcctacctggccggggccggcctcctcttcagcatcatgaagaacgccaacaacacccggcgcgggaccggcaacatcggcgagaccctgggggagaagtggaagtcccgcctgaacgccctcggcaagagcgagttccagatctacaagaagtccgggatccaggaggtggaccggacgctggcgaaggagggcatcaagcgcggggagaccgaccaccacgccgtcagccggggctccgccaagctgcgctggttcgtggagcggaacatggtgacccccgagggcaaggtcgtggacctcgggtgcggccgcgggggctggagctactactgcgggggcctgaagaacgtgcgggaggtcaagggcctgaccaagggcgggcccgggcacgaggagcccatcccgatgtccacgtacggctggaacctcgtgcgcctgcagagcggggtggacgtcttcttcatcccgcccgagaagtgcgacaccctgctctgcgacatcggcgagtccagccccaacccgaccgtggaggccggccggaccctgcgcgtgctgaacctcgtcgagaactggctgaacaacgacacgcagttctgcatcaaggtgctgaacccctacatgccctccgtgatcgagaagatggaggcgctgcagcggaagtacgggggcgccctcgtccgcaacccgctgagccggaacagcacccacgagatgtactgggtgtccaacgccagcgggaacatcgtgtccagcgtcaacatgatctcccgcatgctgatcaaccggttcaccatgcgccacaagaaggccacctacgagcccgacgtggacctcggcagcgggacccggaacatcggcatcgagtccgagatccccaacctggacatcatcggcaagcgcatcgagaagatcaagcaggagcacgagacgagctggtactacgaccaggaccacccctacaagacctgggcctaccacgggtcctacgagaccaagcagaccggcagcgcgtccagcatggtgaacggggtcgtgcggctgctcacgaagccgtgggacgtgctgcccaccgtcacccagatggccatgaccgacacgacccccttcggccagcagcgcgtgttcaaggagaaggtggacacccgcacccaggagcccaaggagggcacgaagaagctgatgaagatcaccgccgagtggctctggaaggagctggggaagaagaagaccccgcggatgtgcacccgcgaggagttcatccggaaggtccgctccaacgccgccctgggcgcgatcttcacggacgagaacaagtggaagtccgcccgggaggccgtggaggactcccgcttctgggagctcgtggacaaggagcggaacctgcacctggaggggaagtgcgagacctgcgtctacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgtccggggtggagggcgaggggctccacaagctgggctacatcctgcgcgacgtcagcaagaaggagggcggggccatgtacgccgacgacaccgcgggctgggacacccggatcacgctcgaggacctgaagaacgaggagatggtgaccaaccacatggagggggagcacaagaagctggccgaggccatcttcaagctcacctaccagaacaaggtggtccgcgtgcagcggcccacgccccggggcacggtgatggacatcatcagccggcgcgaccagcgggggtccggccaggtcggcacctacgggctgaacaccttcaccaacatggaggcccagctgatccgccagatggagggcgagggggtgttcgagaacatccagcacctcacggtgaccgaggaggtcgccgtgcagaactggctggcgcgggtgggccgcgagcgcctgagccggatggccatctccggcgacgactgcgtcgtgaagcccctcgacgaccgcttcgccaacgccctgaccgccctgaacgacatggggaagatccggaaggacatccagcagtgggagccgagcaagggctggaacgactggacccaggtgcccttctgctcccaccacttccacgagctcatcatgaaggacgggcgcgtcctggtggtgccctgccggaaccaggacgagctgatcggccgcgcgcggatcagccagggggccggctggtccctccgcgagacggcctgcctgggcaagagctacgcccagatgtggtccctgatgtacttccaccggcgcgacctccggctggccgcgaacgccatctgcagcgccgtcccctcccactgggtgccgaccagccgcaccacctggtccatccacgccaagcacgagtggatgacgaccgaggacatgctgaccgtgtggaaccgggtctggatccgcgagaacccctggatggaggacaagacccccgtggagagctgggaggagatcccctacctcgggaagcgggaggaccagtggtgcggctccctgatcgggctgaccagccgcgccacgtgggcgaagaacatccaggccgccatcaaccaggtgcggtccctcatcggcaacgaggagtacaccgactacatgccgagcatgaagcgcttccggcgcgaggaggaggaggccggggtcctgtggtga

SEQ ID NO: 9163 - RNA, 9876 nt, synthetic construct
  misc_feature 1..9876: note = derived and/or modified CDS sequence (opt1) from DENV-2__FJ639702__SS-prME
  source 1..9876: mol_type = other RNA
accgccggcgtgatcatcatgctgatccccaccgccatggcgttccacctcaccacccggaacggggagccccacatgatcgtcggccggcaggagaagggcaagagcctgctgttcaagaccgaggacggcgtgaacatgtgcaccctcatggccatcgacctgggggagctgtgcgaggacacgatcacctacaagtgccccctcctgcggcagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcggcaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaaggagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagctccaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggctccaactggatccagaaggagacgctggtgaccttcaagaacccccacgcgaagaagcaggacgtggtcgtgctcgggagccaggagggcgccatgcacaccgccctgaccggggccacggagatccagatgagctccggcaacctcctgttcaccggccacctgaagtgccgcctgcggatggacaagctccagctgaaggggatgagctactccatgtgcaccggcaagttcaagatcgtcaaggagatcgccgagacccagcacgggacgatcgtgatccgcgtgcagtacgagggcgacggcagcccctgcaagatccccttcgagatcatggacctggagaagcggcacgtcctcgggcgcctgatcaccgtgaacccgatcgtgaccgagaaggactcccccgtcaacatcgaggcggagccgcccttcggcgacagctacatcatcatcggggtggagccgggccagctgaagctcaactggttcaagaaggggtccagcatcggccagatgttcgagaccacgatgcgcggcgccaagcggatggccatcctgggggacaccgcctgggacttcggctccctcggcggggtgttcaccagcatggggaaggccctccaccaggtcttcggggcgatctacggcgccgccttctccggggtgagctggaccatgaagatcctgatcggcgtgatcatcacgtggatcgggatgaactcccgcagcacctccctgagcgtctccctggtgctcgtgggcgtcatcaccctgtacctgggggccatggtgcaggcggacagcggctgcgtggtctcctggaagaacaaggagctcaagtgcggcagcgggatcttcatcaccgacaacgtgcacacgtggaccgagcagtacaagttccagcccgagagcccctccaagctggccagcgccatccagaaggcccacgaggagggcatctgcgggatccggtccgtgacccgcctggagaacctcatgtggaagcagatcacccccgagctgaaccacatcctgagcgagaacgaggtcaagctcacgatcatgaccggcgacatcaaggggatcatgcaggccggcaagcggtccctgcgcccgcagcccaccgagctgaagtacagctggaagacctggggcaaggcgaagatgctctccacggagagccacaaccagaccttcctgatcgacgggcccgagaccgccgagtgcccgaacaccaaccgggcctggaactccctggaggtggaggactacggcttcggggtgttcacgaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagagcttcgccgggcccgtgagccagcacaactaccgcccgggctactacacccagacggcggggccctggcacctcggcaagctggagatggacttcgacttctgcgaggggaccaccgtggtcgtgaccgaggactgcggcaaccggggcccctccctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcgtgggcaccaagcacgcgatcctgctcgtcgccgtgagcctggtgacgctgatcaccgggaacatgtccttccgggacctcggccgcgtcatggtgatggtgggggccaccatgaccgacgacatcggcatgggcgtcacgtacctggccctgctcgccgcgttcaaggtgcgccccaccttcgccgccgggctgctgctccggaagctgaccagcaaggagctgatgatggccaccatcggcatcgccctcctgtcccagagcacgatccccgagaccatcctggagctcaccgacgcgctggccctggggatgatggtgctcaagatcgtccgcaacatggagaagtaccagctggccgtgaccatcatggccatctcctgcgtgccgaacgccgtcatcctgcagaacgcgtggaaggtgagctgcacgatcctcgccgccgtgtccgtcagccccctgctgctcacctccagccagcagaaggccgactggatccccctggcgctgaccatcaagggcctcaaccccaccgccatcttcctgacgaccctgtcccggaccagcaagaagcgctcctggccgctcaacgaggccatcatggccgtgggcatggtcagcatcctggccagctccctgctcaagaacgacatccccatgaccgggcccctggtggcgggcgggctgctcacggtgtgctacgtcctgaccggccggagcgccgacctggagctcgagcgcgccaccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtgatcagcggcctcttcccggtctccatccccatcaccgccgcggcctggtacctgtgggaggtgaagaagcagcgcgccggcgtgctgtgggacgtccccagcccgccgcccgtggggaaggccgagctcgaggacggcgcctaccggatcaagcagaaggggatcctgggctactcccagatcggcgcgggggtgtacaaggagggcaccttccacacgatgtggcacgtcacccgcggggccgtgctgatgcaccggggcaagcgcatcgagcccagctgggccgacgtgaagaaggacctcatctcctacgggggcggctggaagctggagggggagtggaaggagggcgaggaggtccaggtgctggccctcgagcccgggaagaacccccgggccgtgcagaccaagcccggcctgttcaagaccaacacggggaccatcggcgcggtcagcctggacttctcccccggcaccagcgggtcccccatcgtggaccgcaagggcaaggtggtcgggctctacggcaacggcgtggtgacccggagcggggcctacgtcagcgccatcgcccagacggagaagtccatcgaggacaaccccgagatcgaggacgacatcttccgcaagaagcggctgaccatcatggacctgcaccccggcgcggggaagaccaagcgctacctgcccgccatcgtgcgggaggccatcaagcgcggcctccggaccctgatcctggccccgacgcgcgtggtcgccgcggagatggaggaggccctccgcgggctgcccatccggtaccagacccccgccatccgcgccgagcacaccggccgggagatcgtggacctgatgtgccacgccaccttcacgatgcgcctcctgagccccgtgcgggtcccgaactacaacctgatcatcatggacgaggcgcacttcaccgaccccgcctccatcgccgcccgcggctacatcagcacccgggtggagatgggggaggccgcgggcatcttcatgaccgccacgccgcccgggtccaaggacccgttcccccagagcaacgcccccatcatggacgaggagcgcgagatccccgagcggtcctggaacagcggccacgagtgggtgaccgacttcaaggggaagaccgtctggttcgtgccgtccatcaaggccggcaacgacatcgcggcctgcctccgcaagaacggcaagaaggtgatccagctgagccggaagaccttcgactccgagtacgtcaagacgcgcaccaacgactgggacttcgtggtgaccaccgacatcagcgagatgggggccaacttcaaggccgagcgggtcatcgacccccgccggtgcatgaagcccgtgatcctgacggacggcgaggagcgcgtgatcctcgccgggcccatgccggtcacccactccagcgcggcccagcggcgcggccggatcgggcgcaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtggacgccatcgacggggagtaccggctgcgcggcgaggcgcggaagaccttcgtggacctgatgcgccgcggggacctccccgtctggctggcctaccgcgtggccgccgagggcatcaactacgccgaccggcgctggtgcttcgacggggtgaagaacaaccagatcctggaggagaacgtcgaggtggagatctggacgaaggagggcgagcggaagaagctcaagccgcgctggctggacgcgcggatctacagcgaccccctggccctcaaggagttcaaggagttcgccgccggccgcaagtccctgaccctgaacctcatcaccgagatggggcggctgcccaccttcatgacgcagaaggcgcgcgacgccctggacaacctcgccgtgctgcacaccgccgaggccggcgggcgggcgtacaaccacgccctgagcgagctccccgagaccctggagaccctgctcctgctgacgctcctggccaccgtcaccggcggcgtgttcctgttcctcatgtccgggaagggcgtcgggaagatgaccctgggcatgtgctgcatcatcaccgccagcatcctgctctggtacgcccagatccagccgcactggatcgcggccagcatcatcctggagttcttcctgatcgtgctcctgatccccgagcccgagaagcagcgcacgccccaggacaaccagctgacctacgtggtcatcgccatcctcaccgtggtggccgccaccatggcgaacgagatggggttcctggagaagacgaagaaggacctgggcctcggctccatcgccacccaggagccggagagcaacatcctggacatcgacctgcggcccgcctccgcctggaccctctacgccgtcgcgaccacgttcgtgacccccatgctgcgccacagcatcgagaactccagcgtgaacgtctccctgaccgccatcgccaaccaggccaccgtgctcatggggctgggcaaggggtggcccctgagcaagatggacatcggcgtgccgctcctggcgatcgggtgctactcccaggtcaaccccgtgacgctgaccgccgccctcctgctgctcgtggcccactacgccatcatcggccccggcctgcaggcgaaggccacccgggaggcccagaagcgcgccgccgcggggatcatgaagaaccccaccgtcgacggcatcacggtgatcgacctggacccgatcccctacgaccccaagttcgagaagcagctcgggcaggtcatgctgctgatcctctgcgtcacccaggtgctgatgatgcggaccacctgggccctgtgcgaggccctcacgctggccaccggccccatcagcaccctgtgggaggggaacccgggccgcttctggaacaccacgatcgccgtgtccatggcgaacatcttccgcggcagctacctcgccggggccggcctgctgttctccatcatgaagaacaccaccaacacccggcgcgggacgggcaacatcggcgagaccctcggggagaagtggaagtcccggctgaacgccctgggcaagtccgagttccagatctacaagaagtccgggatccaggaggtcgaccgcaccctcgcgaaggagggcatcaagcgcggggagaccgaccaccacgccgtgtcccgcggcagcgccaagctgcggtggttcgtggagcgcaacatggtcacgcccgagggcaaggtggtggacctggggtgcggccgcggcgggtggtcctactactgcggcgggctcaagaacgtcaaggaggtgaaggggctgaccaagggcgggcccgggcacgaggagcccatcccgatgagcacctacggctggaacctggtgcgcctccagagcggggtcgacgtgttcttcacgccgcccgagaagtgcgacacgctgctgtgcgacatcggcgagtccagccccaacccgaccatcgaggccggccggaccctccgcgtgctgtccctggtcgagaactggctcaacaacgacacccagttctgcatcaaggtgctgaacccctacatgcccagcgtgatcgagaagatggagaccctgcagcggaagtacgggggcgccctggtccgcaacccgctctcccggaacagcacgcacgagatgtactgggtgtccaacgcgaccgggaacatcgtgagctccgtcaacatgatcagccgcatgctgatcaaccggttcaccatgaagcacaagaaggccacctacgagcccgacgtggacctgggctccgggacgcgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagaccaagcagacgggctccgccagctccatggtgaacggggtcgtgcgcctgctgaccaagccgtgggacgtggtccccatggtgacccagatggccatgaccgacacgacccccttcggccagcagcgcgtgttcaaggagaaggtcgacacccggacccaggagcccaaggagggcacgaagaagctcatgaagatcaccgcggagtggctgtggaaggagctggggaagaagaagaccccgcgcatgtgcacccgggaggagttcacgcgcaaggtgcggagcaacgccgccctcggcgccatcttcaccgacgagaacaagtggaagtccgcccgcgaggcggtggaggacagccggttctgggagctggtcgacaaggagcgcaacctgcacctcgaggggaagtgcgagacctgcgtgtacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgagaacagcctctccggggtcgagggcgaggggctgcacaagctgggctacatcctccgggacgtgggcaagaaggagggcggggccatgtacgccgacgacaccgccgggtgggacacgcgcatcaccctggaggacctgaagaacgaggagatggtgaccaaccacatggagggcgagcacaagaagctcgccgaggcgatcttcaagctgacctaccagaacaaggtcgtgcgggtgcagcgccccacgccccgggggaccgtcatggacatcatcagccgccgggaccagcgcggctccggccaggtggggacctacggcctgaacaccttcacgaacatggaggcccagctcatccggcagatggagggggagggcatcttcaagagcatccagcacctgaccgccaccgaggagatcgccgtgcagaactggctggcccgcgtcggccgcgagcggctctcccgcatggcgatcagcggggacgactgcgtggtgaagcccctggacgaccggttcgcctccgccctgaccgccctcaacgacatgggcaaggtccgcaaggacatccagcagtgggagccgagccgggggtggaacgactggacccaggtgcccttctgctcccaccacttccacgagctgatcatgaaggacggccgcgtgctggtcgtgccctgccggaaccaggacgagctcatcgggcgcgcccggatcagccagggcgcgggctggtccctgaaggagaccgcctgcctgggcaagagctacgcccagatgtggtccctcatgtacttccaccgccgggacctgcgcctggccgccaacgcgatctgcagcgccgtgccctcccactgggtcccgaccagccggaccacctggagcatccacgccaagcacgagtggatgacgaccgaggacatgctcaccgtgtggaaccgcgtgtggatccaggagaacccctggatggaggacaagacccccgtcgagtcctgggaggaggtgccctacctgggcaagcgggaggaccagtggtgcgggagcctgatcggcctcacgtcccgcgccacctgggcgaagaacatccagaccgccatcaaccaggtgcggagcctgatcgggaacgaggagtacaccgactacatgccgtccatgaagcgcttccggcgcgaggaggaggaggccggcgtcctgtggtga

SEQ ID NO: 9164 - RNA, 9876 nt, synthetic construct
  misc_feature 1..9876: note = derived and/or modified CDS sequence (opt1) from DENV-2__GQ868621__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacatcctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgcgggcccctggcacctggggaagctggagatggacttcgacttctgcgacggcaccaccgtgatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgcgatcctcctggtggccgtctccttcatgaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtgacgatcatggccatcctgtgcgtcccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcacaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggcggggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggcggagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacgtacgtggtgatcgccatcctgaccgtcgtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtcacgcccatgctgcggcacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgcgaggcccagaagcgggccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatctccaccctctgggagggcaacccggggcggttctggaacaccaccatcgcggtcagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtgagccgggggtccgccaagctgcgctggttcgtcgagcggaacatggtgacccccgagggcaaggtggtcgacctcggctgcgggcgcggcgggtggagctactactgcggcgggctgaagaacgtgcgggaggtgaagggcctgacgaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacgcggaacatcgggatcgagtccgaggtgcccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcggctgctcaccaagccgtgggacgtgctgcccaccgtcacccagatggccatgacggacaccacccccttcgggcagcagcgcgtgttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtccgctccaacgccgccctgggggcgatcttcaccgacgagaacaagtggaagtccgcccgggaggccgtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtggtccgcgtgcagcggcccacgccccgggggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggaggtcgccgtgcagaactggctggcgcgggtggggcgcgagcgcctgagccggatggccatctccggcgacgactgcgtcgtgaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtgcggtccctcatcgggaacgaggagtacaccgactacatgccgagcatgaagcgcttccggcgcgaggaggaggaggccggcgtcctgtggtga

SEQ ID NO: 9165 - RNA, 9876 nt, synthetic construct
  misc_feature 1..9876: note = derived and/or modified CDS sequence (opt1) from DENV-2__FJ639704__SS-prME
  source 1..9876: mol_type = other RNA
agcgcgggcatgatcatcatgctgatccccaccgtggtggccttccacctcaccacccggaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtcacctacgggacctgcaccaccaccggcgagcaccgccgggagaagcgcagcgtggccctggtgccccacgtcgggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtggcgccctccatgaccatgcggtgcatcggcatcagcaaccgcgacttcgtggagggcgtctccgggggcagctgggtggacatcgtgctcgagcacgggtcctgcgtcaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgcgatgttcacgtgcaagaagaacatggagggcaagatcgtgcagcccgagaacctggagtacaccatcgtggtcacgccccactccggggaggagcacgccgtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgcgaagaagcaggacgtggtcgtgctcggcagccaggagggggccatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggcggagccgcccttcggggacagctacatcatcatcggcgtggagccggggcagctgaagctcaactggttcaagaagggctccagcatcgggcagatgttcgagaccaccatgcgcggcgccaagcgcatggccatcctgggcgacaccgcctgggacttcgggtccctgggcggggtgttcacgagcatcggcaaggccctccaccaggtcttcggggcgatctacggcgccgccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggcgagcgccatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaagaccaagatgctcagcaccgagtcctacaaccagacgttcctgatcgacggccccgagaccaccgagtgcccgaacaccaaccgcgcgtggaacagcctggaggtggaggactacgggttcggcgtcttcacgaccaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgccggcccctggcacctggggaagctggagatggacttcgacttctgcgacggcacgaccgtgatcgtcaccgaggactgcgggaaccggggcccctccctccgcaccacgaccgcgagcggcaagctgatcaccgagtggtgctgccggagctgcaccctgcccccgctccgctaccgcggggaggacggctgctggtacgggatggagatccgccccctgaaggagaaggaggagaacctggtgaactccctcgtgacggccggccacgggcaggtcgacaacttcagcctgggcgtgctgggcatggccctcttcctggaggagatgctgcggacccgcgtggggaccaagcacgccatcctcctggtcgcggtgtccttcgtgaccctgatcacgggcaacatgagcttcaaggacctcgggcgggtcgtggtgatggtcggcgccaccatggccgacgacatcgggatgggcgtgacctacctggccctgctcgccgcgttcaaggtgcgccccaccttcgccgccggcctgctgctccggaagctgacgtccaaggagctgatgatgaccaccatcgggatcgtcctcctgagccagtccaccatccccgagacgatcctggagctcaccgacgccctggccctgggcatgatggtgctcaagatcgtgcgcaacatggagaagtaccagctggcggtcaccatcatggccatcctgtgcgtgccgaacgccgtcatcctccagaacgcctggaaggtgagctgcaccatcctggccgtggtctccgtgagccccctgctcctgacgtccagccagcagaaggcggactggatccccctggccctcaccatcaaggggctgaaccccaccgccatcttcctgaccacgctctcccgcaccaacaagaagcggagctggccgctgaacgaggccatcatggcggtgggcatggtctccatcctggccagctccctcctgaagaacgacatccccatgaccggccccctggtggccgggggcctcctgaccgtgtgctacgtcctgacggggcgcagcgccgacctcgagctggagcgggccaccgacgtgaagtgggaggagcaggcggagatctccggcagcagccccatcctgtccatcaccatcagcgaggacgggtccatgagcatcaagaacgaggaggaggagcagaccctcacgatcctgatccgcaccggcctgctcgtgatctccggcctgttcccgatcagcatccccatcaccgccgccgcctggtacctgtgggaggtcaagaagcagcgggccggggtgctctgggacgtgcccagcccgccgcccatgggcaaggcggagctggaggacggggcctaccgcatcaagcagaagggcatcctggggtacagccagatcggcgccggcgtctacaaggaggggaccttccacaccatgtggcacgtgacgcggggcgccgtgctcatgcacaaggggaagcgcatcgagccctcctgggccgacgtcaagaaggacctgatcagctacggcgggggctggaagctggagggcgagtggaaggagggggaggaggtccaggtgctcgcgctggagcccggcaagaacccccgggccgtccagaccaagcccgggctgttcaagaccaacaccggcacgatcggggccgtgtccctcgacttcagccccggcacctccggcagccccatcatcgacaagaaggggaaggtggtcggcctgtacgggaacggcgtggtgacccgctccggcgcctacgtcagcgccatcgcgcagaccgagaagtccatcgaggacaaccccgagatcgaggacgacatcttccggaagcgccggctgacgatcatggacctgcaccccggggccggcaagaccaagcgctacctccccgccatcgtgcgggaggccatcaagcgcgggctgcggaccctgatcctcgcgccgacccgcgtggtcgccgccgagatggaggaggccctgcggggcctgcccatccgctaccagacgcccgccatccgggcggagcacaccgggcgcgagatcgtggacctcatgtgccacgccaccttcaccatgcgcctgctgagccccgtgcgggtcccgaactacaacctcatcatcatggacgaggcccacttcacggaccccgcctccatcgccgcgcgcggctacatcagcacccgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgacggacttcaagggcaagaccgtctggttcgtgccgagcatcaaggcggggaacgacatcgccgcctgcctgcggaagaacggcaagaaggtgatccagctgtcccgcaagaccttcgacagcgagtacgtcaagacccggacgaacgactgggacttcgtggtgaccaccgacatctccgagatgggcgccaacttcaaggcggagcgcgtcatcgacccccggcgctgcatgaagcccgtgatcctcaccgacggggaggagcgggtgatcctggccggccccatgccggtcacgcacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgagcatgttcgagcccgagcgcgagaaggtggacgccatcgacggcgagtaccggctgcgcggggaggcccgcaagaccttcgtggacctcatgcggcgcggcgacctgcccgtctggctggcctacaaggtggccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgacgctcaacctgatcaccgagatgggccggctgcccaccttcatgacccagaagacgcgcgacgccctcgacaacctggccgtgctgcacaccgccgaggccggcgggcgggcctacaaccacgccctctccgagctgcccgagaccctggagaccctcctgctgctcacgctgctggccaccgtcaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacctacgtggtcatcgccatcctgaccgtggtggccgcgaccatggccaacgagatgggcttcctggagaagacgaagaaggacctcgggctgggctccatcgccacccagcagccggagagcaacatcctggacatcgacctccgccccgcctccgcctggaccctgtacgcggtcgccaccacgttcatcacccccatgctgcggcacagcatcgagaacagctccgtgaacatcagcctcaccgccatcgccaaccaggccaccgtgctgatgggcctggggaagggctggcccctctccaagatggacatcggggtcccgctgctggcgatcggctgctacagccaggtgaaccccatcacgctcaccgccgccctgctgctcctggtggcccactacgcgatcatcgggcccggcctgcaggccaaggccacccgcgaggcccagaagcgggccgcggccggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcgcaccacctgggccctctgcgaggccctgacgctggccaccgggcccatctccaccctctgggagggcaacccggggcggttctggaacaccacgatcgcggtgagcatggccaacatcttccgcggctcctacctggccggcgccgggctcctcttcagcatcatgaagaacaccaccaacacccggcgcggcacggggaacatcggcgagaccctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacgcccgagggcaaggtggtggacctcggctgcgggcgcggcgggtggagctactactgcggcgggctgaagaacgtcaaggaggtgaagggcctgaccaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgacggtggaggccggccgcaccctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacgtacgagcccgacgtggacctcgggagcggcacccgcaacatcgggatcgagtccgaggtccccaacctggacatcatcggcaagcggatcgagaagatcaagcaggagcacgagaccagctggcactacgaccaggaccacccctacaagacctgggcctaccacggctcctacgagacgaagcagaccgggagcgcgtccagcatggtgaacggcgtggtccgcctgctcaccaagccgtgggacgtgctgcccaccgtgacgcagatggccatgaccgacaccacccccttcgggcagcagcgggtcttcaaggagaaggtggacacgcgcacccaggagcccaaggagggcaccaagaagctgatgaagatcaccgccgagtggctctggaaggagctgggcaagaagaagacgccgcgcatgtgcacccgggaggagttcacccgcaaggtgcggtccaacgccgccctgggggcgatcttcaccgacgagaacaagtggaagtccgcccgcgaggccgtcgaggactcccggttctgggagctcgtggacaaggagcgcaacctgcacctggagggcaagtgcgagacgtgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacaccgcggggtgggacacccgcatcaccctcgaggacctgaagaacgaggagatggtcacgaaccacatggagggcgagcacaagaagctggccgaggccatcttcaagctcacctaccagaacaaggtggtgcgggtccagcgccccacgccccgggggaccgtgatggacatcatcagccgccgggaccagcgcggctccggccaggtggggacgtacggcctgaacaccttcaccaacatggaggcccagctgatccggcagatggagggggagggcgtcttcaagaacatccagcacctcaccgtgacggaggaggtggccgtccagaactggctggcgcgcgtggggcgggagcgcctgagccgcatggccatctccggcgacgactgcgtggtcaagcccctcgacgaccggttcgccaacgccctgaccgccctgaacgacatgggcaagatccgcaaggacatccagcagtgggagccgagcaaggggtggaacgactggacccaggtgcccttctgctcccaccacttccacgagctcatcatgaaggacggccgggtgctggtcgtgccctgccgcaaccaggacgagctgatcgggcgggcgcgcatcagccagggcgccgggtggtccctccgggagaccgcctgcctgggcaagagctacgcccagatgtggtccctgatgtacttccaccgccgggacctccgcctggccgcgaacgccatctgcagcgccgtgccctcccactgggtcccgacgagccggaccacctggtccatccacgccaagcacgagtggatgaccaccgaggacatgctgacggtgtggaaccgcgtgtggatccgggagaacccctggatggaggacaagacccccgtcgagagctgggaggagatcccctacctcggcaagcgcgaggaccagtggtgcgggtccctgatcggcctgaccagccgggccacctgggcgaagaacatccaggccgccatcaaccaggtgcgctccctcatcgggaacgaggagtacacggactacatgccgagcatgaagcggttccgccgggaggaggaggaggccggcgtgctgtggtga

SEQ ID NO: 9166 - RNA, 9876 nt, synthetic construct
  misc_feature 1..9876: note = derived and/or modified CDS sequence (opt1) from DENV-2__GQ868622__SS-prME
  source 1..9876: mol_type = other RNA
agcgcgggcatgatcatcatgctgatccccaccgtgatggccttccacctcaccacccggaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcggagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggcccggcagcccgccaccctccgcaagtactgcatcgaggccaagctgaccaacacgaccaccgagagccggtgccccacccagggcgagccctccctgaaggaggagcaggacaagcgcttcgtctgcaagcacagcatggtggaccggggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccgcaccggcctcgacttcaacgagatggtcctgctgcagatggagaacaaggcctggctcgtgcaccggcagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctgttcaccggccacctgaagtgccgcctgcggatggacaagctccagctgaaggggatgagctactccatgtgcacgggcaagttcaaggtggtgaaggagatcgccgagacccagcacgggaccatcgtcatccgcgtgcagtacgagggcgacggcagcccctgcaagatccccttcgagatcatggacctggagaagcggtacgtgctcgggcgcctgatcaccgtcaacccgatcgtgacggagaaggactcccccgtgaacatcgaggcggagccgcccttcggcgacagctacatcatcatcggggtcgagccgggccagctgaagctcaactggttcaagaaggggtccagcatcggccagatgttcgagaccaccatgcgcggcgccaagcggatggccatcctgggggacaccgcctgggacttcggctccctcggcggggtgttcacgagcatcgggaaggccctccaccaggtgttcggggcgatctacggcgccgccttctccggggtcagctggaccatgaagatcctgatcggcgtgatcatcacctggatcgggatgaactcccgcagcacctccctgagcgtgtccctggtcctcgtgggcatcgtgacgctgtacctgggggtcatggtgcaggccgacagcggctgcgtggtctcctggaagaacaaggagctcaagtgcggcagcgggatcttcatcaccgacaacgtgcacacctggaccgagcagtacaagttccagcccgagagcccctccaagctggcgagcgccatccagaaggcccaggaggagggcatctgcgggatccggtccgtgacgcgcctggagaacctcatgtggaagcagatcacccccgagctgaaccacatcctggccgagaacgaggtcaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgaaggagaagcaggacgccttctgcgactccaagctgatgagcgccgcgatcaaggacaaccgcgccgtccacgccgacatgggctactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgcggggcccgtcagccagcacaactaccggccgggctaccacacccagatcgccgggccctggcacctgggcaagctggagatggacttcgacttctgcgacgggaccaccgtgatcgtgacggaggactgcggcaaccgcggcccctccctccggaccaccaccgccagcgggaagctgatcacggagtggtgctgccgcagctgcaccctgcccccgctccggtaccgcggcgaggacgggtgctggtacggcatggagatccggcccctgaaggagaaggaggagaacctggtcaactccctcgtgaccgccgggcacggccaggtggacaacttcagcctgggcgtcctggggatggccctgttcctggaggagatgctgcgcacccgggtgggcacgaagcacgccatcctcctggtggccgtctccttcgtgaccctgatcaccgggaacatgagcttcaaggacctcggccgcgtggtcgtgatggtgggggccaccatgacggacgacatcggcatgggcgtcacctacctggccctgctcgcggccttcaaggtgcggcccaccttcgccgccgggctgctgctccgcaagctgacctccaaggagctgatgatgacgaccatcggcatcgtgctcctgagccagtccaccatccccgagaccatcctggagctcacggacgccctggcgctggggatgatggtcctcaagatcgtgcgcgacatggagaagtaccagctggccgtgaccatcatggccatcctgtgcgtcccgaacgccgtgatcctccagaacgcctggaaggtcagctgcaccatcctggcggtggtgtccgtcagccccctgctcctgacctccagccagcagaagacggactggatccccctggccctcaccatcaagggcctgaaccccaccgccatcttcctgaccacgctctcccggaccaacaagaagcgcagctggccgctgaacgaggccatcatggcggtgggcatggtgtccatcctggccagctccctcctgaagaacgacatccccatgaccgggcccctggtcgccggcgggctcctgaccgtgtgctacgtgctgacgggccggagcgccgacctcgagctggagcgcgccaccgacgtcaagtgggaggaccaggcggagatctccgggagcagccccatcctgtccatcaccatcagcgaggacggctccatgagcatcaagaacgaggaggaggagcagaccctcacgatcctgatccggaccggcctgctcgtgatctccgggctgttcccggtgagcatccccatcaccgccgccgcctggtacctgtgggaggtcaagaagcagcgcgccggcgtgctctgggacgtgcccagcccgccgcccatggggaaggcggagctggaggacggcgcctaccggatcaagcagaaggggatcctgggctacagccagatcggcgccggggtctacaaggagggcaccttccacaccatgtggcacgtgacgcgcggggccgtgctcatgcacaagggcaagcggatcgagccctcctgggccgacgtcaagaaggacctgatcagctacgggggcggctggaagctggagggggagtggaaggagggcgaggaggtccaggtgctcgcgctggagcccgggaagaacccccgcgccgtccagaccaagcccggcctgttcaagaccaacaccgggacgatcggcgccgtgtccctcgacttcagccccggcacctccgggagccccatcatcgacaagaagggcaaggtggtcgggctgtacggcaacggcgtggtgacccggtccggggcctacgtcagcgccatcgcgcagaccgagaagtccatcgaggacaaccccgagatcgaggacgacatcttccgcaagcggcgcctgacgatcatggacctgcaccccggcgccgggaagaccaagcggtacctccccgccatcgtgcgcgaggccatcaagcggggcctgcgcaccctgatcctcgcgccgacccgggtggtcgccgccgagatggaggaggccctgcgcgggctgcccatccggtaccagacgcccgccatccgcgcggagcacaccggccgcgagatcgtggacctcatgtgccacgccaccttcaccatgcggctgctgagccccgtgcgcgtcccgaactacaacctcatcatcatggacgaggcccacttcacggaccccgcctccatcgccgcgcggggctacatcagcacccgcgtggagatgggggaggccgccggcatcttcatgaccgccacgccgcccgggagccgggacccgttcccccagtccaacgcccccatcatcgacgaggagcgcgagatccccgagcggagctggaactccggccacgagtgggtgacggacttcaaggggaagaccgtctggttcgtgccgagcatcaaggcgggcaacgacatcgccgcctgcctgcgcaagaacggcaagaaggtgatccagctgtcccggaagaccttcgacagcgagtacgtcaagacccgcacgaacgactgggacttcgtggtgaccaccgacatctccgagatgggggccaacttcaaggcggagcgggtcatcgacccccgccggtgcatgaagcccgtgatcctcaccgacggcgaggagcgcgtgatcctggccgggcccatgccggtcacgcacagctccgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacccccgagggcatcatcccgagcatgttcgagcccgagcgggagaaggtggacgccatcgacggggagtaccgcctgcgcggcgaggcccggaagaccttcgtggacctcatgcgccgcggggacctgcccgtctggctggcctacaaggtggccgcggagggcatcaactacgccgaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgacgctcaacctgatcaccgagatggggcgcctgcccaccttcatgacccagaagacgcgggacgccctcgacaacctggccgtgctgcacaccgccgaggcgggcgggcgcgcctacaaccacgccctctccgagctgcccgagaccctggagaccctcctgctgctcacgctgctggccaccgtcaccggcggcatcttcctcttcctgatgagcgggcggggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacctacgtggtcatcgccatcctgaccgtggtggccgcgaccatggccaacgagatggggttcctggagaagacgaagaaggacctcggcctgggctccatcgccacccagcagccggagagcaacatcctggacatcgacctccggcccgcctccgcctggaccctgtacgcggtcgccaccacgttcgtgacccccatgctgcgccacagcatcgagaacagctccgtgaacgtcagcctcaccgccatcgccaaccaggccaccgtgctgatggggctgggcaaggggtggcccctctccaagatggacatcggcgtgccgctgctggcgatcgggtgctacagccaggtcaaccccatcacgctcaccgccgccctgctgctcctggtggcccactacgcgatcatcggccccggcctgcaggccaaggccacccgggaggcccagaagcgcgccgcggccgggatcatgaagaaccccaccgtggacggcatcacggtcatcgacctcgacccgatcccctacgaccccaagttcgagaagcagctgggccaggtgatgctgctcatcctgtgcgtgacccaggtcctgatgatgcggaccacctgggccctctgcgaggccctgacgctggccaccggccccatctccaccctctgggaggggaacccgggccgcttctggaacaccacgatcgcggtgagcatggccaacatcttccggggctcctacctggccggggccggcctcctcttcagcatcatgaagaacaccaccaacacccgccgcgggacgggcaacatcggcgagaccctgggggagaagtggaagtcccggctgaacgccctcggcaagagcgagttccagacctacaagaagtccgggatccaggaggtggaccgcaccctggcgaaggagggcatcaagcgcggggagacggaccaccacgccgtcagccgcggctccgccaagctgcggtggttcgtggagcgcaacatggtgacccccgagggcaaggtcgtggacctcgggtgcggccgcggcgggtggagctactactgcggcgggctgaagaacgtgcgcgaggtcaaggggctgaccaagggcggccccgggcacgaggagcccatcccgatgtccacctacggctggaacctcgtgcggctgcagagcggggtggacgtcttcttcatcccgcccgagaagtgcgacacgctgctctgcgacatcggcgagtccagccccaacccgaccgtggaggccggccgcaccctgcgggtgctgaacctcgtcgagaactggctgaacaacaacacccagttctgcatcaaggtgctgaacccctacatgccctccgtgatcgagaagatggaggcgctgcagcgcaagtacgggggcgccctcgtccggaacccgctgagccgcaacagcacccacgagatgtactgggtgtccaacgccagcgggaacatcgtgtccagcgtcaacatgatctcccggatgctgatcaaccgcttcacgatgcggcacaagaaggccacctacgagcccgacgtggacctcggcagcgggacccgcaacatcggcatcgagtccgagatccccaacctggacatcatcggcaagcggatcgagaagatcaagcaggagcacgagaccagctggcactacgaccaggaccacccctacaagacgtgggcctaccacgggtcctacgagaccaagcagaccggcagcgcgtccagcatggtgaacggggtcgtgcgcctgctcaccaagccgtgggacgtgctgcccacggtcacccagatggccatgaccgacaccacgcccttcggccagcagcgcgtgttcaaggagaaggtggacacccggacccaggagcccaaggagggcaccaagaagctgatgaagatcacggccgagtggctctggaaggagctggggaagaagaagaccccgcgcatgtgcacccgggaggagttcacccgcaaggtccggtccaacgccgccctgggcgcgatcttcacggacgagaacaagtggaagtccgcccgcgaggccgtggaggaccggcgcttctgggagctcgtggacaaggagcggaacctgcacctggaggggaagtgcgagacctgcgtctacaacatgatgggcaagcgcgagaagaagctcggggagttcggcaaggccaagggctcccgggccatctggtacatgtggctgggggcgcgcttcctggagttcgaggccctcggcttcctgaacgaggaccactggttcagccgggagaactccctgagcggggtggagggcgaggggctccacaagctgggctacatcctgcgcgacgtctccaagaaggagggcggggccatgtacgccgacgacaccgcgggctgggacacccggatcacgctcgaggacctgaagaacgaggagatggtgaccaaccacatggagggggagcacaagaagctggccgaggccatcttcaagctcacctaccagaacaaggtggtccgcgtgcagcggcccacgccccggggcacggtgatggacatcatcagccggcgcgaccagcgggggagcggccaggtcggcacctacgggctgaacaccttcaccaacatggaggcccagctgatccgccagatggagggcgagggggtgttcaagaacatccagcacctcacggccaccgaggaggtggcggtccagaactggctggcccgcgtgggccgggagcgcctgtcccggatggccatcagcggcgacgactgcgtggtcaagcccctcgacgaccgcttcgccaacgccctgaccgcgctgaacgacatggggaagatccggaaggacatccagcagtgggagccgtccaagggctggaacgactggacccaggtgcccttctgcagccaccacttccacgagctcatcatgaaggacgggcgcgtgctggtcgtgccctgccggaaccaggacgagctgatcggccgcgcccggatctcccagggggccggctggagcctccgcgagacggcctgcctgggcaagtcctacgcccagatgtggagcctgatgtacttccaccggcgcgacctccggctggcggccaacgccatctgctccgccgtgcccagccactgggtcccgacctcccgcaccacctggagcatccacgccaagcacgagtggatgaccacggaggacatgctgaccgtgtggaaccgggtgtggatccgcgagaacccctggatggaggacaagacccccgtcgagtcctgggaggagatcccctacctcgggaagcgggaggaccagtggtgcggcagcctgatcgggctgacctcccgcgcgacgtgggccaagaacatccaggccgccatcaaccaggtgcggagcctcatcggcaacgaggagtacaccgactacatgccgtccatgaagcgcttccgccgggaggaggaggaggcgggggtgctgtggtga

SEQ ID NO: 9167 - RNA, 9876 nt, synthetic construct
  misc_feature 1..9876: note = derived and/or modified CDS sequence (opt1) from DENV-2__FJ639705__SS-prME
  source 1..9876: mol_type = other RNA
agcgcgggcatgatcatcatgctgatccccaccgtgatggccttccacctcaccacccggaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcggatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggcccggcagcccgccaccctccgcaagtactgcatcgaggccaagctgaccaacacgaccaccgagagccggtgccccacccagggcgagccctccctgaaggaggagcaggacaagcgcttcgtctgcaagcacagcatggtggaccggggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccgcaccggcctcgacttcaacgagatggtcctgctgcagatggagaacaaggcctggctcgtgcaccggcagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctgttcaccggccacctgaagtgccgcctgcggatggacaagctccagctgaaggggatgagctactccatgtgcacgggcaagttcaaggtggtgaaggagatcgccgagacccagcacgggaccatcgtcatccgcgtgcagtacgagggcgacggcagcccctgcaagatccccttcgagatcatggacctggagaagcggtacgtgctcgggcgcctgatcaccgtcaacccgatcgtgacggagaaggactcccccgtgaacatcgaggcggagccgcccttcggcgacagctacatcatcatcggggtcgagccgggccagctgaagctcaactggttcaagaaggggtccagcatcggccagatgttcgagaccaccatgcgcggcgccaagcggatggccatcctgggggacaccgcctgggacttcggctccctcggcggggtgttcacgagcatcgggaaggccctccaccaggtgttcggggcgatctacggcgccgccttctccggggtcagctggaccatgaagatcctgatcggcgtgatcatcacctggatcgggatgaactcccgcagcacctccctgagcgtgtccctggtcctcgtgggcatcgtgacgctgtacctgggggtcatggtgcaggccgacagcggctgcgtggtctcctggaagaacaaggagctcaagtgcggcagcgggatcttcatcaccgacaacgtgcacacctggaccgagcagtacaagttccagcccgagagcccctccaagctggcgagcgccatccagaaggcccaggaggagggcatctgcgggatccggtccgtgacgcgcctggagaacctcatgtggaagcagatcacccccgagctgaaccacatcctggccgagaacgaggtcaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgaaggagaagcaggacgccttctgcgactccaagctgatgagcgccgcgatcaaggacaaccgcgccgtccacgccgacatgggctactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgcggggcccgtcagccagcacaactaccggccgggctaccacacccagatcgccgggccctggcacctgggcaagctggagatggacttcgacttctgcgacgggaccaccgtgatcgtgacggaggactgcggcaaccgcggcccctccctccggaccaccaccgccagcgggaagctgatcacggagtggtgctgccgcagctgcaccctgcccccgctccggtaccgcggcgaggacgggtgctggtacggcatggagatccggcccctgaaggagaaggaggagaacctggtcaactccctcgtgaccgccgggcacggccaggtggacaacttcagcctgggcgtcctggggatggccctcttcctggaggagatgctgcgcacccgggtgggcacgaagcacgccatcctcctggtggccgtctccttcgtgaccctgatcaccgggaacatgagcttcaaggacctcggccgcgtggtcgtgatggtgggggccaccatgacggacgacatcggcatgggcgtcacctacctggccctgctcgcggccttcaaggtgcggcccaccttcgccgccgggctgctgctccgcaagctgacctccaaggagctgatgatgacgaccatcggcatcgtgctcctgagccagtccaccatccccgagaccatcctggagctcacggacgccctggcgctggggatgatggtcctcaagatcgtgcgcgacatggagaagtaccagctggccgtgaccatcatggccatcctgtgcgtcccgaacgccgtgatcctccagaacgcctggaaggtcagctgcaccatcctggcggtggtgtccgtcagccccctgctcctgacctccagccagcagaagacggactggatccccctggccctcaccatcaagggcctgaaccccaccgccatcttcctgaccacgctctcccggaccaacaagaagcgcagctggccgctgaacgaggccatcatggcggtgggcatggtgtccatcctggccagctccctcctgaagaacgacatccccatgaccgggcccctggtcgccggcgggctcctgaccgtgtgctacgtgctgacgggccggagcgccgacctcgagctggagcgcgccaccgacgtcaagtgggaggaccaggcggagatctccgggagcagccccatcctgtccatcaccatcagcgaggacggctccatgagcatcaagaacgaggaggaggagcagaccctcacgatcctgatccggaccggcctgctcgtgatctccgggctgttcccggtgagcatccccatcaccgccgccgcctggtacctgtgggaggtcaagaagcagcgcgccggcgtgctctgggacgtgcccagcccgccgcccatggggaaggcggagctggaggacggcgcctaccggatcaagcagaaggggatcctgggctacagccagatcggcgccggggtctacaaggagggcaccttccacaccatgtggcacgtgacgcgcggggccgtgctcatgcacaagggcaagcggatcgagccctcctgggccgacgtcaagaaggacctgatcagctacgggggcggctggaagctggagggggagtggaaggagggcgaggaggtccaggtgctcgcgctggagcccgggaagaacccccgcgccgtccagaccaagcccggcctgttcaagaccaacaccgggacgatcggcgccgtgtccctcgacttcagccccggcacctccgggagccccatcatcgacaagaagggcaaggtggtcgggctgtacggcaacggcgtggtgacccggtccggggcctacgtcagcgccatcgcgcagaccgagaagtccatcgaggacaaccccgagatcgaggacgacatcttccgcaagcggcgcctgacgatcatggacctgcaccccggcgccgggaagaccaagcggtacctccccgccatcgtgcgcgaggccatcaagcggggcctgcgcaccctgatcctcgcgccgacccgggtggtcgccgccgagatggaggaggccctgcgcgggctgcccatccggtaccagacgcccgccatccgcgcggagcacaccggccgcgagatcgtggacctcatgtgccacgccaccttcaccatgcggctgctgagccccgtgcgcgtcccgaactacaacctcatcatcatggacgaggcccacttcacggaccccgcctccatcgccgcgcggggctacatcagcacccgcgtggagatgggggaggccgccggcatcttcatgaccgccacgccgcccgggagccgggacccgttcccccagtccaacgcccccatcatcgacgaggagcgcgagatccccgagcggagctggaactccggccacgagtgggtgacggacttcaaggggaagaccgtctggttcgtgccgagcatcaaggcgggcaacgacatcgccgcctgcctgcgcaagaacggcaagaaggtgatccagctgtcccggaagaccttcgacagcgagtacgtcaagacccgcacgaacgactgggacttcgtggtgaccaccgacatctccgagatgggggccaacttcaaggcggagcgggtcatcgacccccgccggtgcatgaagcccgtgatcctcaccgacggcgaggagcgcgtgatcctggccgggcccatgccggtcacgcacagctccgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacccccgagggcatcatcccgagcatgttcgagcccgagcgggagaaggtggacgccatcgacggggagtaccgcctgcgcggcgaggcccggaagaccttcgtggacctcatgcgccgcggggacctgcccgtctggctggcctacaaggtggccgcggagggcatcaactacgccgaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgacgctcaacctgatcaccgagatggggcgcctgcccaccttcatgacccagaagacgcgggacgccctcgacaacctggccgtgctgcacaccgccgaggcgggcgggcgcgcctacaaccacgccctctccgagctgcccgagaccctggagaccctcctgctgctcacgctgctggccaccgtcaccggcggcatcttcctcttcctgatgagcgggcggggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacctacgtggtcatcgccatcctgaccgtggtggccgcgaccatggccaacgagatggggttcctggagaagacgaagaaggacctcggcctgggctccatcgccacccagcagccggagagcaacatcctggacatcgacctccggcccgcctccgcctggaccctgtacgcggtcgccaccacgttcgtgacccccatgctgcgccacagcatcgagaacagctccgtgaacgtcagcctcaccgccatcgccaaccaggccaccgtgctgatggggctgggcaaggggtggcccctctccaagatggacatcggcgtgccgctgctggcgatcgggtgctacagccaggtcaaccccatcacgctcaccgccgccctgctgtccctcgtggcccactacgcgatcatcggccccggcctgcaggccaaggccacccgggaggcccagaagcgcgccgcggccgggatcatgaagaaccccaccgtggacggcatcacggtcatcgacctggacccgatcccctacgaccccaagttcgagaagcagctcggccaggtgatgctgctgatcctctgcgtgacccaggtcctgatgatgcggaccacctgggccctgtgcgaggccctcacgctggccaccggccccatcagcaccctgtgggaggggaacccgggccgcttctggaacaccacgatcgcggtgtccatggccaacatcttccggggcagctacctcgccggggccggcctgctgttctccatcatgaagaacaccaccaacacccgccgcgggacgggcaacatcggcgagaccctcggggagaagtggaagtcccggctgaacgccctgggcaagtccgagttccagacctacaagaagtccgggatccaggaggtggaccgcaccctcgcgaaggagggcatcaagcgcggggagacggaccaccacgccgtctcccgcggcagcgccaagctgcggtggttcgtggagcgcaacatggtgacccccgagggcaaggtcgtggacctggggtgcggccgcggcgggtggtcctactactgcggcgggctcaagaacgtgcgcgaggtcaaggggctgaccaagggcggccccgggcacgaggagcccatcccgatgagcacctacggctggaacctggtgcggctccagtccggggtggacgtcttcttcatcccgcccgagaagtgcgacacgctgctgtgcgacatcggcgagagctcccccaacccgaccgtggaggccggccgcaccctccgggtgctgaacctggtcgagaactggctcaacaacaacacccagttctgcatcaaggtgctgaacccctacatgcccagcgtgatcgagaagatggaggcgctgcagcgcaagtacgggggcgccctggtccggaacccgctcagccgcaactccacccacgagatgtactgggtgagcaacgcctccgggaacatcgtgagctccgtcaacatgatcagccggatgctgatcaaccgcttcacgatgcggcacaagaaggccacctacgagcccgacgtggacctgggctccgggacccgcaacatcggcatcgagagcgagatccccaacctcgacatcatcggcaagcggatcgagaagatcaagcaggagcacgagacctcctggcactacgaccaggaccacccctacaagacgtgggcctaccacgggagctacgagaccaagcagaccggctccgcgagctccatggtgaacggggtcgtgcgcctgctgaccaagccgtgggacgtgctccccacggtcacccagatggccatgaccgacaccacgcccttcggccagcagcgcgtgttcaaggagaaggtggacacccggacccaggagcccaaggagggcaccaagaagctgatgaagatcacggccgagtggctgtggaaggagctcgggaagaagaagaccccgcgcatgtgcacccgggaggagttcacccgcaaggtccggagcaacgccgccctgggcgcgatcttcacggacgagaacaagtggaagtccgcccgcgaggccgtggaggacagccggttctgggagctggtggacaaggagcgcaacctccacctggaggggaagtgcgagacctgcgtctacaacatgatgggcaagcgggagaagaagctgggggagttcggcaaggccaagggctcccgcgccatctggtacatgtggctcggggcgcggttcctggagttcgaggccctgggcttcctcaacgaggaccactggttcagccgcgagaactccctgagcggggtggagggcgaggggctgcacaagctcggctacatcctgcgggacgtcagcaagaaggagggcggggccatgtacgccgacgacaccgcgggctgggacacccgcatcacgctggaggacctcaagaacgaggagatggtgaccaaccacatggagggggagcacaagaagctggccgaggccatcttcaagctgacctaccagaacaaggtggtccgggtgcagcgccccacgccccggggcacggtgatggacatcatctcccgccgggaccagcgcgggagcggccaggtcggcacctacgggctcaacaccttcaccaacatggaggcccagctgatccggcagatggagggcgagggggtgttcaagaacatccagcacctgacggccaccgaggaggtggcggtccagaactggctcgcccgcgtgggccgcgagcggctgtcccgcatggccatcagcggcgacgactgcgtggtcaagcccctggacgaccggttcgccaacgccctcaccgcgctgaacgacatggggaagatccgcaaggacatccagcagtgggagccgtccaagggctggaacgactggacccaggtgcccttctgcagccaccacttccacgagctgatcatgaaggacgggcgggtgctcgtcgtgccctgccgcaaccaggacgagctgatcggccgggcccgcatctcccagggggccggctggagcctgcgggagacggcctgcctcggcaagtcctacgcccagatgtggagcctgatgtacttccaccgccgggacctgcgcctcgcggccaacgccatctgctccgccgtgcccagccactgggtcccgacctcccggaccacctggagcatccacgccaagcacgagtggatgaccacggaggacatgctgaccgtgtggaaccgcgtgtggatccgggagaacccctggatggaggacaagacccccgtcgagtcctgggaggagatcccctacctggggaagcgcgaggaccagtggtgcggcagcctcatcgggctgacctcccgggcgacgtgggccaagaacatccaggccgccatcaaccaggtgcgcagcctgatcggcaacgaggagtacaccgactacatgccgagcatgaagcggttccgccgcgaggaggaggaggcgggggtgctctggtga

SEQ ID NO: 9168 - RNA, 9876 nt, synthetic construct
  misc_feature 1..9876: note = derived and/or modified CDS sequence (opt1) from DENV-2__FJ639706__SS-prME
  source 1..9876: mol_type = other RNA
agcgccggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctgttcaccggccacctgaagtgccggctgcgcatggacaagctccagctgaaggggatgagctactccatgtgcacgggcaagttcaaggtggtgaaggagatcgccgagacccagcacgggaccatcgtcatccgggtgcagtacgagggcgacggcagcccctgcaagatccccttcgagatcatggacctggagaagcgctacgtgctcgggcggctgatcaccgtcaacccgatcgtgacggagaaggactcccccgtgaacatcgaggcggagccgcccttcggcgacagctacatcatcatcggggtcgagccgggccagctgaagctcaactggttcaagaaggggtccagcatcggccagatgttcgagaccaccatgcgcggcgccaagcgcatggccatcctgggggacaccgcctgggacttcggctccctcggcggggtgttcacgagcatcgggaaggccctccaccaggtgttcggcgcgatctacggcgccgccttctccggggtcagctggaccatgaagatcctgatcggcgtgatcatcacctggatcgggatgaactcccggagcacctccctgagcgtgtccctggtcctcgtgggcatcgtgacgctgtacctgggggtcatggtgcaggccgacagcggctgcgtggtctcctggaagaacaaggagctcaagtgcggcagcgggatcttcatcaccgacaacgtgcacacctggaccgagcagtacaagttccagcccgagagcccctccaagctggcgagcgccatccagaaggcccaggaggagggcatctgcgggatccgctccgtgacgcggctggagaacctcatgtggaagcagatcacccccgagctgaaccacatcctggccgagaacgaggtcaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtggaggactacggcttcggggtgttcaccaccaacatctggctcaagctgaaggagaagcaggacgccttctgcgactccaagctgatgagcgccgcgatcaaggacaaccgggccgtccacgccgacatgggctactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgcggggcccgtcagccagcacaactaccgcccgggctaccacacccagatcgccgggccctggcacctgggcaagctggagatggacttcgacttctgcgacgggaccaccgtgatcgtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtcaactccctcgtgaccgccgggcacggccaggtggacaacttcagcctgggcgtcctggggatggccctgttcctggaggagatgctgcggacccgcgtgggcacgaagcacgccatcctcctggtggccgtctccttcgtgaccctgatcaccgggaacatgagcttcaaggacctcggccgggtggtcgtgatggtgggggccaccatgacggacgacatcggcatgggcgtcacctacctggccctgctcgcggccttcaaggtgcgccccaccttcgccgccgggctgctgctccggaagctgacctccaaggagctgatgatgacgaccatcggcatcgccctcctgagccagtccaccatccccgagaccatcctggagctcacggacgcgctggccctggggatgatggtgctcaagatcgtccgcgacatggagaagtaccagctggccgtgaccatcatggccatcctgtgcgtgccgaacgccgtcatcctccagaacgcgtggaaggtgagctgcaccatcctggccgtcgtgtccgtgagccccctgctcctgacctccagccagcagaagacggactggatccccctggccctcaccatcaagggcctgaaccccaccgccatcttcctgaccacgctctcccgcaccaacaagaagcggagctggccgctgaacgaggcgatcatggccgtcggcatggtgtccatcctggccagctccctcctgaagaacgacatccccatgaccgggcccctggtggccggcgggctcctgaccgtctgctacgtgctgacgggccgcagcgccgacctcgagctggagcgggcgaccgacgtgaagtgggaggaccaggccgagatctccgggagcagccccatcctgtccatcaccatcagcgaggacggctccatgagcatcaagaacgaggaggaggagcagaccctcacgatcctgatccgcaccggcctgctcgtcatctccgggctgttcccggtgagcatccccatcaccgccgccgcctggtacctgtgggaggtgaagaagcagcgggcgggcgtcctctgggacgtgcccagcccgccgcccatggggaaggccgagctggaggacggcgcctaccgcatcaagcagaaggggatcctgggctacagccagatcggcgccggggtgtacaaggagggcaccttccacaccatgtggcacgtcacgcgcggggcggtgctcatgcacaagggcaagcgcatcgagccctcctgggcggacgtgaagaaggacctgatcagctacgggggcggctggaagctggagggggagtggaaggagggcgaggaggtccaggtgctcgccctggagcccgggaagaacccccgggccgtgcagaccaagcccggcctgttcaagaccaacaccgggacgatcggcgccgtctccctcgacttcagccccggcacctccgggagccccatcatcgacaagaagggcaaggtggtggggctgtacggcaacggcgtcgtgacccgctccggggcctacgtgagcgcgatcgcccagaccgagaagtccatcgaggacaaccccgagatcgaggacgacatcttccggaagcgccggctgacgatcatggacctgcaccccggcgccgggaagaccaagcgctacctccccgccatcgtccgggaggcgatcaagcgcggcctgcggaccctgatcctcgccccgacccgcgtggtggccgccgagatggaggaggccctgcgggggctgcccatccgctaccagacgcccgcgatccgggccgagcacaccggccgcgagatcgtcgacctcatgtgccacgccaccttcaccatgcgcctgctgagccccgtgcgggtgccgaactacaacctcatcatcatggacgaggcccacttcacggaccccgcctccatcgcggcccgcggctacatcagcacccgggtcgagatgggggaggccgccggcatcttcatgaccgccacgccgcccgggagccgcgacccgttcccccagtccaacgcgcccatcatcgacgaggagcgggagatccccgagcgcagctggaactccggccacgagtgggtgacggacttcaaggggaagaccgtgtggttcgtcccgagcatcaaggccggcaacgacatcgccgcctgcctgcggaagaacggcaagaaggtgatccagctgtcccgcaagaccttcgacagcgagtacgtgaagacccggacgaacgactgggacttcgtcgtgaccaccgacatctccgagatgggggcgaacttcaaggccgagcgcgtgatcgacccccggcgctgcatgaagcccgtcatcctcaccgacggcgaggagcgggtgatcctggccgggcccatgccggtgacgcacagctccgccgcccagcgccggggccgcatcgggcggaaccccaagaacgagaacgaccagtacatctacatgggcgagcccctggagaacgacgaggactgcgcgcactggaaggaggccaagatgctcctggacaacatcaacacccccgagggcatcatcccgagcatgttcgagcccgagcgcgagaaggtcgacgccatcgacggggagtaccggctgcgcggcgaggcccgcaagaccttcgtggacctcatgcggcgcggggacctgcccgtgtggctggcctacaaggtcgcggccgagggcatcaactacgccgaccggcgctggtgcttcgacgggatcaagaacaaccagatcctcgaggagaacgtggaggtggagatctggaccaaggagggcgagcggaagaagctgaagccgcgctggctggacgcccggatctactccgaccccctcgccctgaaggagttcaaggagttcgcggccggccgcaagagcctgacgctcaacctgatcaccgagatggggcggctgcccaccttcatgacccagaagacgcgcgacgccctcgacaacctggccgtcctgcacaccgcggaggccggcgggcgggcctacaaccacgccctctccgagctgcccgagaccctggagaccctcctgctgctcacgctgctggccaccgtgaccggcggcatcttcctcttcctgatgagcgggcgcggcatcgggaagatgaccctgggcatgtgctgcatcatcaccgcgtccatcctcctgtggtacgcccagatccagccgcactggatcgccgccagcatcatcctggagttcttcctcatcgtcctgctgatccccgagcccgagaagcagcggacgccccaggacaaccagctcacctacgtggtgatcgccatcctgaccgtcgtggcggccaccatggccaacgagatggggttcctggagaagacgaagaaggacctcggcctgggctccatcgccacccagcagccggagagcaacatcctggacatcgacctccgccccgcctccgcgtggaccctgtacgccgtggccaccacgttcgtcacccccatgctgcggcacagcatcgagaacagctccgtgaacgtgagcctcaccgccatcgccaaccaggcgaccgtcctgatggggctgggcaaggggtggcccctctccaagatggacatcggcgtgccgctgctggccatcgggtgctacagccaggtgaaccccatcacgctcaccgccgccctgctgctcctggtcgcgcactacgccatcatcggccccggcctgcaggccaaggccacccgcgaggcccagaagcgggcggccgccgggatcatgaagaaccccaccgtggacggcatcacggtgatcgacctcgacccgatcccctacgaccccaagttcgagaagcagctggggcaggtcatgctgctcatcctgtgcgtgacccaggtgctgatgatgcgcaccacctgggccctctgcgaggccctgacgctggcgaccggccccatctccaccctctgggaggggaacccgggccggttctggaacaccacgatcgccgtcagcatggccaacatcttccgcggctcctacctggccggggccggcctcctcttcagcatcatgaagaacaccaccaacacccggcgcgggacgggcaacatcggcgagaccctgggggagaagtggaagtcccgcctgaacgcgctcggcaagagcgagttccagacctacaagaagtccgggatccaggaggtggaccggaccctggccaaggagggcatcaagcgcggggagacggaccaccacgccgtgagccggggctccgccaagctgcgctggttcgtcgagcggaacatggtgacccccgagggcaaggtggtcgacctcgggtgcggccgcgggggctggagctactactgcgggggcctgaagaacgtgcgggaggtgaagggcctgaccaagggcggccccgggcacgaggagcccatcccgatgtccacctacggctggaacctcgtccgcctgcagagcggggtggacgtgttcttcatcccgcccgagaagtgcgacacgctgctctgcgacatcggcgagtccagccccaacccgaccgtcgaggcgggccggaccctgcgcgtgctgaacctcgtggagaactggctgaacaacaacacccagttctgcatcaaggtcctgaacccctacatgccctccgtgatcgagaagatggaggccctgcagcggaagtacgggggcgccctcgtgcgcaacccgctgagccggaacagcacccacgagatgtactgggtctccaacgccagcgggaacatcgtgtccagcgtgaacatgatctcccgcatgctgatcaaccggttcacgatgcgccacaagaaggccacctacgagcccgacgtcgacctcggcagcgggacccggaacatcggcatcgagtccgagatccccaacctggacatcatcggcaagcgcatcgagaagatcaagcaggagcacgagaccagctggcactacgaccaggaccacccctacaagacgtgggcgtaccacgggtcctacgagaccaagcagaccggcagcgcctccagcatggtgaacggggtggtccggctgctcaccaagccgtgggacgtgctgcccacggtgacccagatggccatgaccgacaccacgcccttcggccagcagcgcgtcttcaaggagaaggtggacacccgcacccaggagcccaaggagggcaccaagaagctgatgaagatcacggccgagtggctctggaaggagctggggaagaagaagaccccgcggatgtgcacccgcgaggagttcacccggaaggtgcgctccaacgccgcgctgggcgccatcttcacggacgagaacaagtggaagtccgcccgggaggccgtcgaggactcccgcttctgggagctcgtggacaaggagcggaacctgcacctggaggggaagtgcgagacctgcgtgtacaacatgatgggcaagcgcgagaagaagctcggggagttcggcaaggccaagggcagccgggcgatctggtacatgtggctgggggcccgcttcctggagttcgaggccctcggcttcctgaacgaggaccactggttctcccgggagaacagcctgtccggggtcgagggcgaggggctccacaagctgggctacatcctgcgcgacgtgagcaagaaggagggcggggccatgtacgcggacgacaccgccggctgggacacccggatcacgctcgaggacctgaagaacgaggagatggtcaccaaccacatggagggggagcacaagaagctggccgaggccatcttcaagctcacctaccagaacaaggtggtgcgcgtccagcggcccacgccccggggcacggtgatggacatcatcagccggaaggaccagcgcgggtccggccaggtgggcacctacgggctgaacaccttcaccaacatggaggcccagctgatccggcagatggagggcgagggggtcttcaagaacatccagcacctcacggcgaccgaggaggtggccgtgcagaactggctggcccgcgtcggccgggagcgcctgagccgcatggccatctccggcgacgactgcgtggtgaagcccctcgacgaccggttcgccaacgcgctgaccgccctgaacgacatggggaagatccgcaaggacatccagcagtgggagccgagcaagggctggaacgactggacccaggtccccttctgctcccaccacttccacgagctcatcatgaaggacgggcgggtgctggtggtcccctgccgcaaccaggacgagctgatcggccgggcccgcatcagccagggggccggctggtccctccgggagacggcctgcctgggcaagagctacgcgcagatgtggtccctgatgtacttccaccgccgggacctccgcctggccgccaacgccatctgcagcgccgtgccctcccactgggtgccgaccagccggaccacctggtccatccacgcgaagcacgagtggatgaccacggaggacatgctgaccgtctggaaccgcgtgtggatccgggagaacccctggatggaggacaagacccccgtggagagctgggaggagatcccctacctcgggaagcgcgaggaccagtggtgcggctccctgatcgggctgaccagccgggccacgtgggccaagaacatccaggccgcgatcaaccaggtccgctccctcatcggcaacgaggagtacaccgactacatgccgagcatgaagcggttccgccgggaggaggaggaggccggggtgctgtggtga

SEQ ID NO: 9169 - RNA, 9876 nt, synthetic construct
  misc_feature 1..9876: note = derived and/or modified CDS sequence (opt1) from DENV-2__FJ639707__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacatcctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacgaccgagtgcccgaacaccaaccgcgcgtggaacagcctggaggtggaggactacgggttcggcgtgttcaccacgaacatctggctcaagctgaaggagaagcaggacgccttctgcgactccaagctgatgagcgccgccatcaaggacaaccgggccgtccacgcggacatggggtactggatcgagtccgccctcaacgacacctggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgccggcccctggcacctggggaagctggagatggacttcgacttctgcgacggcaccacggtgatcgtgaccgaggactgcgggaaccggggcccctccctccgcaccaccacggcgagcggcaagctgatcaccgagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacgcgcgtggggaccaagcacgccatcctcctggtggcggtctccttcatgaccctgatcaccggcaacatgagcttcaaggacctcgggcgggtggtggtcatggtgggcgccacgatggccgacgacatcgggatgggcgtgacctacctggccctgctcgccgcgttcaaggtccgccccaccttcgccgccggcctgctgctccggaagctgacctccaaggagctgatgatgacgaccatcgggatcgtgctcctgagccagtccaccatccccgagaccgtgctggagctcacggacgccctggccctgggcatgatggtcctcaagatcgtgcgcaacatggagaagtaccagctggcggtgaccatcatggccatcctgtgcgtcccgaacgccgtgatcctccagaacgcctggaaggtcagctgcaccatcctggccgtggtgtccgtcagccccctgctcctgacctccagccagcagaagacggactggatccccctggcgctcaccatcaaggggctgaaccccaccgccatcttcctgaccacgctctcccgcaccaacaagaagcggagctggccgctgaacgaggccatcatggccgtgggcatggtgtccatcctggcgagctccctcctgaagaacgacatccccatgaccggccccctggccgccgggggcctcctgaccgtctgctacgtgctgacggggcgcagcgccgacctcgagctggagcgggccaccgacgtgaagtgggaggaccaggcggagatctccggcagcagccccatcctgtccatcaccatcagcgaggacgggtccatgagcatcaagaacgaggaggaggagcagaccctcacgatcctgatccgcaccggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacgcggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagaccaagcccgggctgttcaagaccaacaccggcacgatcggggccgtgtccctcgacttcagccccggcacctccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgacgatcatggacctgcaccccggggccggcaagaccaagcgctacctccccgccatcgtgcgggaggccatcaagcgcgggctgcggaccctgatcctcgcgccgacccgcgtcgtggccgccgagatggaggaggccctgcggggcctgcccatccgctaccagacgcccgccatccgggcggagcacaccgggcgcgagatcgtggacctcatgtgccacgccaccttcaccatgcgcctgctgagccccgtccgggtgccgaactacaacctcatcatcatggacgaggcccacttcacggaccccgcctccatcgccgcgcgcggctacatcagcacccgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcacggacttcaagggcaagaccgtgtggttcgtgccgagcatcaaggcggggaacgacatcgccgcctgcctgcggaagaacggcaagaaggtcatccagctgtcccgcaagaccttcgacagcgagtacgccaagacccggacgaacgactgggacttcgtggtgaccaccgacatctccgagatgggcgcgaacttcaaggccgagcgcgtcatcgacccccggcgctgcatgaagcccgtgatcctcaccgacggggaggagcgggtgatcctggccggccccatgccggtcacgcacagctccgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgagcatgttcgagcccgagcgcgagaaggtggacgccatcgacggcgagtaccggctgcgcggggaggcccgcaagaccttcgtggacctcatgcggcgcggcgacctgcccgtctggctggcctacaaggtggcggccgaggggatcaactacgccgaccggcgctggtgcttcgacggcatcaagaacaaccagatcctcgaggagaacgtggaggtcgagatctggaccaaggagggggagcggaagaagctgaagccgcgctggctggactcccggatctacagcgaccccctcgccctgaaggagttcaaggagttcgccgcgggccgcaagtccctgacgctcaacctgatcaccgagatgggccggctgcccaccttcatgacccagaagacgcgcgacgccctcgacaacctggccgtgctgcacaccgccgaggccggcgggcgggcctacaaccacgccctcagcgagctgcccgagaccctggagaccctcctgctgctcacgctgctggccaccgtgaccgggggcatcttcctcttcctgatgtccggccgcgggatcggcaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtcatcgccatcctgaccgtggtggccgcgaccatggccaacgagatgggcttcctggagaagacgaagaaggacctcgggctgggcagcatcgccacccagcagccggagtccaacatcctggacatcgacctccgccccgccagcgcctggaccctgtacgcggtcgccaccacgttcgtgacccccatgctgcggcacagcatcgagaactccagcgtgaacgtctccctcaccgccatcgccaaccaggccaccgtgctggtgggcctggggaagggctggcccctcagcaagatggacatcggggtcccgctgctggcgatcggctgctactcccaggtgaaccccatcacgctcaccgccgccctgctgctcctggtggcccactacgcgatcatcgggcccggcctgcaggccaaggccacccgcgaggcccagaagcgggccgcggccggcatcatgaagaaccccaccgtcgacgggatcacggtgatcgacctcgacccgatcccctacgaccccaagttcgagaagcagctgggccaggtgatgctgctcatcctgtgcgtcacccaggtgctgatgatgcgcaccacctgggccctctgcgaggccctgacgctggccaccgggcccatcagcaccctctgggagggcaacccggggcggttctggaacaccacgatcgcggtgtccatggccaacatcttccgcggcagctacctggccggcgccgggctcctcttctccatcatgaagaacaccaccaacacccggcgcggcacggggaacatcggcgagaccctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgtcccgggggagcgccaagctgcgctggttcgtggagcggaacatggtcacgcccgagggcaaggtggtggacctcggctgcgggcgcggcgggtggtcctactactgcggcgggctgaagaacgtccgggaggtgaagggcctgaccaagggcgggcccggccacgaggagcccatcccgatgagcacctacgggtggaacctcgtgcgcctgcagtccggcgtcgacgtgttcttcatcccgcccgagaagtgcgacaccctgctctgcgacatcggggagagctcccccaacccgacggtggaggccggccggaccctgcgcgtcctgaacctcgtggagaactggctgaacaacaacacccagttctgcatcaaggtgctgaacccctacatgcccagcgtcatcgagaagatggaggcgctgcagcggaagtacggcggggccctcgtgcgcaacccgctgagccggaactccacccacgagatgtactgggtgagcaacgcctccggcaacatcgtcagctccgtgaacatgatcagccgcatgctgatcaaccggttcaccatgcgccacaagaaggccacgtacgagcccgacgtggacctcgggtccggcacccggaacatcgggatcgagagcgaggtccccaacctggacatcatcggcaagcgcatcgagaagatcaagcaggagcacgagacctcctggcactacgaccaggaccacccctacaagacctgggcctaccacggcagctacgagacgaagcagaccgggtccgcgagctccatggtgaacggcgtggtccggctgctcaccaagccgtgggacgtgctgcccaccgtgacgcagatggccatgaccgacaccacccccttcgggcagcagcgcgtcttcaaggagaaggtggacacgcgcacccaggagcccaaggagggcaccaagaagctgatgaagatcaccgccgagtggctctggaaggagctgggcaagaagaagacgccgcggatgtgcacccgcgaggagttcacccggaaggtgcgcagcaacgccgccctgggggcgatcttcaccgacgagaacaagtggaagtccgcccgggaggccgtcgaggacagccgcttctgggagctcgtggacaaggagcggaacctgcacctggagggcaagtgcgagacgtgcgtgtacaacatgatggggaagcgcgagaagaagctcggcgagttcgggaaggccaagggctcccgggccatctggtacatgtggctgggcgcgcgcttcctggagttcgaggccctcgggttcctgaacgaggaccactggttcagccgggagaactccctgagcggcgtcgagggggagggcctccacaagctggggtacatcctgcgcgacgtgagcaagaaggagggcggcgccatgtacgccgacgacaccgcggggtgggacacccggatcaccctcgaggacctgaagaacgaggagatggtcacgaaccacatggagggcgagcacaagaagctggccgaggccatcttcaagctcacctaccagaacaaggtggtgcgcgtccagcggcccacgccccgggggaccgtgatggacatcatctcccggcgcgaccagcggggcagcggccaggtggggacgtacggcctgaacaccttcaccaacatggaggcccagctgatccgccagatggagggggagggcgtcttcaagaacatccagcacctcaccgtgacggaggaggtggccgtccagaactggctggcgcgggtggggcgcgagcgcctgtcccggatggccatcagcggcgacgactgcgtggtcaagcccctcgacgaccgcttcgccaacgccctgaccgccctgaacgacatgggcaagatccggaaggacatccagcagtgggagccgtccaaggggtggaacgactggacccaggtgcccttctgcagccaccacttccacgagctcatcatgaaggacggccgcgtgctggtcgtgccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtgcccagccactgggtcccgacgtcccgcaccacctggagcatccacgccaagcacgagtggatgaccaccgaggacatgctgacggtgtggaaccgggtgtggatccgcgagaacccctggatggaggacaagacccccgtcgagtcctgggaggagatcccctacctcggcaagcgggaggaccagtggtgcgggagcctgatcggcctgacctcccgcgccacctgggcgaagaacatccaggccgccatcaaccaggtgcggagcctcatcgggaacgaggagtacacggactacatgccgagcatgaagcgcttccggcgcgaggaggaggaggccggcgtgctgtggtga

SEQ ID NO: 9170 - RNA, 9876 nt, synthetic construct
  misc_feature 1..9876: note = derived and/or modified CDS sequence (opt1) from DENV-2__FJ639708__SS-prME
  source 1..9876: mol_type = other RNA
agcgcggggatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacatcctcggccggctgatcaccgtcaacccgatcgtgacggagaaggactcccccgtgaacatcgaggccgagccgcccttcggggacagctacatcatcatcggcgtcgagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtgttcggggccatctacggcgcggccttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtgttcaccaccaacatctggctcaagctgaaggagaagcaggacgccttctgcgactccaagctgatgagcgccgccatcaaggacaaccgggcggtccacgccgacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgcgggcccctggcacctggggaagctggagatggacttcgacttctgcgacggcaccaccgtgatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgcgatcctcctggtggccgtctccttcatgaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcaacatggagaagtaccagctggccgtgacgatcatggccatcctgtgcgtcccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggcggggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggcggagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacgtacgtggtgatcgccatcctgaccgtcgtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtcacgcccatgctgcggcacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgcgaggcccagaagcgggccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatctccaccctctgggagggcaacccggggcggttctggaacaccaccatcgcggtcagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtgagccgggggtccgccaagctgcgctggttcgtcgagcggaacatggtgacccccgagggcaaggtggtcgacctcggctgcgggcgcggcgggtggagctactactgcggcgggctgaagaacgtgcgggaggtgaagggcctgacgaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacgcggaacatcgggatcgagtccgaggtgcccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcggctgctcaccaagccgtgggacgtgctgcccaccgtcacccagatggccatgacggacaccacccccttcgggcagcagcgcgtgttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtccgctccaacgccgccctgggggcgatcttcaccgacgagaacaagtggaagtccgcccgggaggccgtggaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtggtccgcgtgcagcggcccacgccccgggggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggaggtcgccgtgcagaactggctggcgcgggtggggcgcgagcgcctgagccggatggccatctccggcgacgactgcgtcgtgaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtgcggtccctcatcgggaacgaggagtacaccgactacatgccgagcatgaagcgcttccggcgcgaggaggaggaggccggcgtcctgtggtga

SEQ ID NO: 9171 - RNA, 9876 nt, synthetic construct
  misc_feature 1..9876: note = derived and/or modified CDS sequence (opt1) from DENV-2__FJ639709__SS-prME
  source 1..9876: mol_type = other RNA
agcgccggcatgatcatcatgctgatccccaccgtgatggccttccacctcaccacccggaacggggagccccacatgatcgtgggcatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacggcacgtgcaccaccaccggcgagcaccgccgggagaagcgcagcgtcgccctggtgccccacgtggggatgggcctcgagacgcggaccgagacctggatgagcagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctgttcaccggccacctgaagtgccggctgcgcatggacaagctccagctgaaggggatgagctactccatgtgcacgggcaagttcaaggtggtgaaggagatcgccgagacccagcacgggaccatcgtcatccgggtgcagtacgagggcgacggcagcccctgcaagatccccttcgagatcatggacctggagaagcgctacgtgctcgggcggctgatcaccgtcaacccgatcgtgacggagaaggactcccccgtgaacatcgaggcggagccgcccttcggcgacagctacatcatcatcggggtcgagccgggccagctgaagctcaactggttcaagaaggggtccagcatcggccagatgttcgagaccaccatgcgcggcgccaagcgcatggccatcctgggggacaccgcctgggacttcggctccctcggcggggtgttcacgagcatcgggaaggccctccaccaggtgttcggggcgatctacggcgccgccttctccggggtcagctggaccatgaagatcctgatcggcgtgatcatcacctggatcgggatgaactcccggagcacctccctgagcgtgtccctggtcctcgtgggcatcgtgacgctgtacctgggggtcatggtgcaggccgacagcggctgcgtggtctcctggaagaacaaggagctcaagtgcggcagcgggatcttcatcaccgacaacgtgcacacctggaccgagcagtacaagttccagcccgagagcccctccaagctggcgagcgccatccagaaggcccaggaggagggcatctgcgggatccgctccgtgacgcggctggagaacctcatgtggaagcagatcacccccgagctgaaccacatcctggccgagaacgaggtcaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtggaggactacggcttcggggtgttcaccaccaacatctggctcaagctgaaggagaagcaggacgccttctgcgactccaagctgatgagcgccgcgatcaaggacaaccgggccgtccacgccgacatgggctactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgcggggcccgtcagccagcacaactaccgcccgggctaccacacccagatcgccgggccctggcacctgggcaagctggagatggacttcgacttctgcgacgggaccaccgtgatcgtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtcaactccctcgtgaccgccgggcacggccaggtggacaacttcagcctgggcgtcctggggatggccctgttcctggaggagatgctgcggacccgcgtgggcacgaagcacgccatcctcctggtggccgtctccttcgtgaccctgatcaccgggaacatgagcttcaaggacctcggccgggtggtcgtgatggtgggggccaccatgacggacgacatcggcatgggcgtcacctacctggccctgctcgcggccttcaaggtgcgccccaccttcgccgccgggctgctgctccggaagctgacctccaaggagctgatgatgacgaccatcggcatcgtgctcctgagccagaccaccatccccgagacgatcctggagctcaccgacgccctggcgctggggatgatggtcctcaagatcgtgcgcgacatggagaagtaccagctggccgtgaccatcatggccatcctgtgcgtcccgaacgccgtgatcctccagaacgcctggaaggtctcctgcaccatcctggcggtggtgagcgtcagccccctgctcctgacgagctcccagcagaagaccgactggatccccctggccctcaccatcaagggcctgaaccccaccgccatcttcctgacgaccctcagccgcaccaacaagaagcggtcctggccgctgaacgaggccatcatggcggtgggcatggtgagcatcctggcctccagcctcctgaagaacgacatccccatgaccgggcccctggtcgccggcgggctcctgacggtgtgctacgtgctgaccggccgctccgccgacctcgagctggagcgggccaccgacgtcaagtgggaggaccaggcggagatcagcgggtccagccccatcctgagcatcaccatctccgaggacggcagcatgtccatcaagaacgaggaggaggagcagacgctcaccatcctgatccgcaccggcctgctcgtgatcagcgggctgttcccggtgtccatccccatcaccgccgccgcctggtacctgtgggaggtcaagaagcagcgggccggcgtgctctgggacgtgccctccccgccgcccatggggaaggcggagctggaggacggcgcctaccgcatcaagcagaaggggatcctgggctactcccagatcggcgccggggtctacaaggagggcaccttccacacgatgtggcacgtgacccgcggggcggtgctcatgcacaagggcaagcgcatcgagcccagctgggccgacgtcaagaaggacctgatctcctacgggggcggctggaagctggagggggagtggaaggagggcgaggaggtccaggtgctcgcgctggagcccgggaagaacccccgggccgtccagaccaagcccggcctgttcaagaccaacacggggaccatcggcgccgtgagcctcgacttctcccccggcaccagcgggtcccccatcatcgacaagaagggcaaggtggtcgggctgtacggcaacggcgtggtgacccgcagcggggcctacgtctccgccatcgcgcagacggagaagtccatcgaggacaaccccgagatcgaggacgacatcttccggaagcgccggctgaccatcatggacctgcaccccggcgccgggaagaccaagcgctacctccccgccatcgtgcgggaggccatcaagcgcggcctgcggaccctgatcctcgcgccgacgcgcgtggtcgccgccgagatggaggaggccctgcgggggctgcccatccgctaccagacccccgccatccgggcggagcacaccggccgcgagatcgtggacctcatgtgccacgccaccttcacgatgcgcctgctgtcccccgtgcgggtcccgaactacaacctcatcatcatggacgaggcccacttcaccgaccccgccagcatcgccgcgcgcggctacatctccacccgggtggagatgggggaggccgccggcatcttcatgaccgccacgccgcccgggagccgcgacccgttcccccagagcaacgcccccatcatcgacgaggagcgggagatccccgagcgctcctggaacagcggccacgagtgggtgaccgacttcaaggggaagaccgtctggttcgtgccgtccatcaaggcgggcaacgacatcgccgcctgcctgcggaagaacggcaagaaggtgatccagctgagccgcaagaccttcgactccgagtacgtcaagacgcggaccaacgactgggacttcgtggtgaccaccgacatcagcgagatgggggccaacttcaaggcggagcgcgtcatcgacccccggcgctgcatgaagcccgtgatcctcacggacggcgaggagcgggtgatcctggccgggcccatgccggtcacccactccagcgccgcccagcgccggggccgcatcgggcggaaccccaagaacgagaacgaccagtacatctacatgggcgagcccctggagaacgacgaggactgcgcccactggaaggaggcgaagatgctcctggacaacatcaacacccccgagggcatcatcccgtccatgttcgagcccgagcgcgagaaggtggacgccatcgacggggagtaccggctgcgcggcgaggcccgcaagaccttcgtggacctcatgcggcgcggggacctgcccgtctggctggcctacaaggtggccgcggagggcatcaactacgccgaccggcgctggtgcttcgacgggatcaagaacaaccagatcctcgaggagaacgtggaggtcgagatctggacgaaggagggcgagcggaagaagctgaagccgcgctggctggacgcccggatctacagcgaccccctcgccctgaaggagttcaaggagttcgccgcgggccgcaagtccctgaccctcaacctgatcaccgagatggggcggctgcccaccttcatgacgcagaagacccgcgacgccctcgacaacctggccgtgctgcacaccgccgaggcgggcgggcgggcctacaaccacgccctcagcgagctgcccgagaccctggagacgctcctgctgctcaccctgctggccaccgtcaccggcggcatcttcctcttcctgatgtccgggcgcggcatcgggaagatgaccctgggcatgtgctgcatcatcacggccagcatcctcctgtggaacgcgcagatccagccgcactggatcgccgcctccatcatcctggagttcttcctcatcgtgctgctgatccccgagcccgagaagcagcggacgccccaggacaaccagctcacctacgtggtcatcgccatcctgaccgtggtggccgcgacgatggccaacgagatggggttcctggagaagaccaagaaggacctcggcctgggcagcatcgccacccagcagccggagtccaacatcctggacatcgacctccgccccgccagcgcctggaccctgtacgcggtcgccacgaccttcgtgacccccatgctgcggcactccatcgagaacagcagcgtgaacgtctccctcaccgccatcgccaaccaggccacggtgctgatggggctgggcaaggggtggcccctcagcaagatggacatcggcgtgccgctgctggcgatcgggtgctactcccaggtcaaccccatcaccctcaccgccgccctgctgctcctggtggcccactacgcgatcatcggccccggcctgcaggccaaggccacccgcgaggcccagaagcgggccgcggccgggatcatgaagaaccccacggtggacggcatcaccgtcatcgacctcgacccgatcccctacgaccccaagttcgagaagcagctgggccaggtgatgctgctcatcctgtgcgtgacccaggtcctgatgatgcgcaccacgtgggccctctgcgaggccctgaccctggccaccggccccatcagcaccctctgggaggggaacccgggccggttctggaacacgaccatcgcggtgtccatggccaacatcttccgcggcagctacctggccggggccggcctcctcttctccatcatgaagaacaccaccaacacgcggcgcgggaccggcaacatcggcgagaccctgggggagaagtggaagtcccgcctgaacgccctcggcaagtccgagttccagacctacaagaagtccgggatccaggaggtggaccggacgctggcgaaggagggcatcaagcgcggggagaccgaccaccacgccgtctcccggggcagcgccaagctgcgctggttcgtggagcggaacatggtgacccccgagggcaaggtcgtggacctcgggtgcggccgcgggggctggtcctactactgcgggggcctgaagaacgtgcgggaggtcaagggcctgaccaagggcgggcccgggcacgaggagcccatcccgatgagcacgtacggctggaacctcgtgcgcctgcagtccggggtggacgtcttcttcatcccgcccgagaagtgcgacaccctgctctgcgacatcggcgagagctcccccaacccgaccgtggaggccggccggaccctgcgcgtgctgaacctcgtcgagaactggctgaacaacaacacccagttctgcatcaaggtgctgaacccctacatgcccagcgtgatcgagaagatggaggcgctgcagcggaagtacgggggcgccctcgtccgcaacccgctgtcccggaacagcacgcacgagatgtactgggtgagcaacgcctccgggaacatcgtgagctccgtcaacatgatcagccgcatgctgatcaaccggttcaccatgcgccacaagaaggccacctacgagcccgacgtggacctcggctccgggacccggaacatcggcatcgagagcgagatccccaacctggacatcatcggcaagcgcatcgagaagatcaagcaggagcacgagacgtcctggcactacgaccaggaccacccctacaagacctgggcctaccacgggagctacgagaccaagcagaccggctccgcgagctccatggtgaacggggtcgtgcggctgctcacgaagccgtgggacgtgctgcccaccgtcacccagatggccatgaccgacacgacccccttcggccagcagcgcgtgttcaaggagaaggtggacacccgcacccaggagcccaaggagggcacgaagaagctgatgaagatcaccgccgagtggctctggaaggagctggggaagaagaagaccccgcggatgtgcacccgcgaggagttcacgcggaaggtccgcagcaacgccgccctgggcgcgatcttcaccgacgagaacaagtggaagtccgcccgggaggccgtggaggacagccgcttctgggagctcgtggacaaggagcggaacctgcacctggaggggaagtgcgagacctgcgtctacaacatgatgggcaagcgcgagaagaagctcggggagttcggcaaggccaagggctcccgggccatctggtacatgtggctgggggcgcgcttcctggagttcgaggccctcggcttcctgaacgaggaccactggttcagccgggagaactccctgagcggggtggagggcgaggggctccacaagctgggctacatcctgcgcgacgtctccaagaaggagggcggggccatgtacgccgacgacaccgcgggctgggacacgcggatcaccctcgaggacctgaagaacgaggagatggtgaccaaccacatggagggggagcacaagaagctggccgaggccatcttcaagctcacctaccagaacaaggtggtccgcgtgcagcggcccacgccccgcggcaccgtgatggacatcatcagccggcgcgaccagcgggggagcggccaggtcggcacctacgggctgaacaccttcacgaacatggaggcccagctgatccgccagatggagggcgagggggtgttcaagaacatccagcacctcaccgccaccgaggaggtggcggtccagaactggctggcccgggtgggccgcgagcgcctgtcccggatggccatcagcggcgacgactgcgtggtcaagcccctcgacgaccgcttcgccaacgccctgaccgcgctgaacgacatggggaagatccggaaggacatccagcagtgggagccgtccaagggctggaacgactggacccaggtgcccttctgcagccaccacttccacgagctcatcatgaaggacgggcgcgtgctggtcgtgccctgccggaaccaggacgagctgatcggccgcgcccggatctcccagggggccggctggagcctccgcgagaccgcctgcctgggcaagtcctacgcccagatgtggagcctgatgtacttccaccggcgcgacctccggctggcggccaacgccatctgctccgccgtgcccagccactgggtcccgacctcccgcaccacctggagcatccacgccaagcacgagtggatgacgaccgaggacatgctgaccgtgtggaaccgggtgtggatccgcgagaacccctggatggaggacaagacccccgtcgagtcctgggaggagatcccctacctcgggaagcgggaggaccagtggtgcggcagcctgatcgggctgacgtcccgcgcgacctgggccaagaacatccaggccgccatcaaccaggtgcggagcctcatcggcaacgaggagtacaccgactacatgccgtccatgaagcgcttccggcgcgaggaggaggaggcgggggtgctgtggtga

SEQ ID NO: 9172 - RNA, 9876 nt, synthetic construct
  misc_feature 1..9876: note = derived and/or modified CDS sequence (opt1) from DENV-2__FJ639710__SS-prME
  source 1..9876: mol_type = other RNA
agcgcgggcatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcggagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggggcgatcgtgacgtgcgccatgttcacgtgcaagaagaacatggagggcaagatcgtccagcccgagaacctggagtacaccatcgtggtgacgccccactccggcgaggagcacgccgtcgggaacgacacgggcaagcacgggaaggagatcaaggtgaccccgcagagctccatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgcggacaagcaggagtccaactggatccagaaggagaccctggtgaccttcaagaacccccacgccaagaagcaggacgtcgtggtcctcgggagccaggagggcgccatgcacacggccctgaccggggccaccgagatccagatgagctccggcaacctcctgttcaccgggcacctgaagtgccggctgcgcatggacaagctccagctgaagggcatgagctactccatgtgcacgggcaagttcaaggtggtgaaggagatcgcggagacccagcacgggaccatcgtcatccgggtgcagtacgagggcgacgggagcccctgcaagatccccttcgagatcatggacctggagaagcgctacgtgctcggccggctgatcaccgtcaacccgatcgtgacggagaaggactcccccgtgaacatcgaggccgagccgcccttcggcgacagctacatcatcatcggggtcgagccgggccagctgaagctcaactggttcaagaaggggtccagcatcggccagatgttcgagaccaccatgcgcggggccaagcgcatggccatcctgggcgacaccgcctgggacttcggctccctcggcggggtgttcacgagcatcgggaaggcgctccaccaggtgttcggggccatctacggggccgccttctccggcgtcagctggaccatgaagatcctgatcggcgtgatcatcacctggatcgggatgaactcccggagcacctccctgagcgtgtccctgatcctcgtcggcatcgtgacgctgtacctgggggtgatggtccaggcggacagcggctgcgtggtgtcctggaagaacaaggagctcaagtgcgggagcggcatcttcatcaccgacaacgtccacacctggaccgagcagtacaagttccagcccgagagcccctccaagctggccagcgccatccagaaggcccaggaggagggcatctgcgggatccgctccgtgacgcggctggagaacctcatgtggaagcagatcacccccgagctgaaccacatcctggccgagaacgaggtgaagctcaccatcatgaccggcgacatcaaggggatcatgcaggcgggccgccggagcctgcgcccgcagcccacggagctgaagtactcctggaagacctgggggaaggccaagatgctcagcaccgagtcctacaaccagaccttcctgatcgacggccccgagacgaccgagtgcccgaacaccaaccgggcctggaacagcctggaggtcgaggactacggcttcggggtgttcaccacgaacatctggctcaagctgaaggagaagcaggacgccttctgcgactccaagctgatgagcgccgcgatcaaggacaaccgcgccgtgcacgccgacatgggctactggatcgagtccgccctcaacgacacctggaagatcgagaaggccagcttcatcgaggtcaagaactgccactggcccaagtcccacaccctgtggagcaacggggtgctggagtccgagatgatcatccccaagaacctcgcgggccccgtgagccagcacaactaccggccgggctaccacacccagatcgccgggccctggcacctgggcaagctggagatggacttcgacttctgcgacgggaccacggtcatcgtgaccgaggactgcggcaaccgcgggccctccctccggaccaccacggccagcggcaagctgatcaccgagtggtgctgccgcagctgcaccctgcccccgctccggtaccgcggcgaggacgggtgctggtacggcatggagatccggcccctgaaggagaaggaggagaacctggtgaactccctcgtcaccgccgggcacggccaggtggacaacttcagcctgggggtgctgggcatggccctgttcctggaggagatgctgcgcacgcgggtcggcaccaagcacgccatcctcctggtggccgtgtccttcgtcaccctgatcaccgggaacatgagcttcaaggacctcggccgcgtggtggtcatggtgggggccacgatggccgacgacatcggcatgggggtgacctacctggcgctgctcgccgccttcaaggtccggcccaccttcgccgccggcctgctgctccgcaagctgacctccaaggagctgatgatgacgaccatcggcatcgtgctcctgagccagtccaccatccccgagaccatcctggagctcacggacgcgctggccctggggatgatggtgctcaagatcgtccgcaacatggagaagtaccagctggccgtgaccatcatggccatcctgtgcgtgccgaacgccgtcatcctccagaacgcgtggaaggtgagctgcaccatcctggccgtcgtgtccgtgagccccctgctcctgacctccagccagcagaagacggactggatccccctggccctcaccatcaagggcctgaaccccaccgccatcttcctgaccacgctctcccggaccaacaagaagcgcagctggccgctgaacgaggcgatcatggccgtcgggatggtgtccatcctggccagctccctcctgaagaacgacatccccatgaccggccccctggtggccggcgggctcctgaccgtctgctacgtgctgacgggccggagcgccgacctcgagctggagcgcgcgaccgacgtgaagtgggaggagcaggccgagatctccgggagcagccccatcctgtccatcaccatcagcgaggacggctccatgagcatcaagaacgaggaggaggagcagaccctcacgatcctgatccggaccgggctgctcgtcatctccggcctgttcccgatcagcatccccatcaccgccgccgcctggtacctgtgggaggtgaagaagcagcgcgcgggcgtgctctgggacgtccccagcccgccgcccatggggaaggccgagctggaggacggcgcctaccggatcaagcagaaggggatcctgggctacagccagatcggggccggcgtgtacaaggagggcaccttccacaccatgtggcacgtgacgcgcggggccgtcctcatgcacaagggcaagcggatcgagccctcctgggcggacgtgaagaaggacctgatcagctacgggggcgggtggaagctggagggcgagtggaaggagggcgaggaggtgcaggtcctcgccctggagcccgggaagaacccccgcgccgtgcagaccaagcccggcctgttcaagaccaacaccgggacgatcggcgccgtgtccctcgacttcagccccgggacctccggcagccccatcatcgacaagaagggcaaggtcgtggggctgtacggcaacggggtggtcacccggtccggcgcctacgtgagcgcgatcgcccagaccgagaagtccatcgaggacaaccccgagatcgaggacgacatcttccgcaagcggcgcctgacgatcatggacctgcaccccggcgccgggaagaccaagcggtacctccccgccatcgtgcgcgaggcgatcaagcggggcctgcgcaccctgatcctcgccccgacccgggtcgtggccgccgagatggaggaggccctgcgcgggctgcccatccggtaccagacgcccgcgatccgcgccgagcacaccggccgcgagatcgtggacctcatgtgccacgccaccttcaccatgcggctgctgagccccgtccgcgtgccgaactacaacctcatcatcatggacgaggcccacttcacggaccccgcctccatcgcggcccgggggtacatcagcacccgcgtggagatgggcgaggccgccggcatcttcatgaccgccacgccgcccgggagccgggacccgttcccccagtccaacgcgcccatcatcgacgaggagcgcgagatccccgagcggagctggaactccggccacgagtggatcacggacttcaaggggaagaccgtctggttcgtgccgagcatcaaggccggcaacgacatcgccgcctgcctgcgcaagaacgggaagaaggtgatccagctgtcccggaagaccttcgacagcgagtacgtcaagacccgcacgaacgactgggacttcgtggtgaccaccgacatctccgagatgggcgcgaacttcaaggccgagcgggtcatcgacccccgccggtgcatgaagcccgtgatcctcaccgacggcgaggagcgcgtgatcctggccgggcccatgccggtcacgcacagctccgccgcccagcggcgcggccggatcgggcgcaaccccaagaacgagaacgaccagtacatctacatgggcgagcccctggagaacgacgaggactgcgcgcactggaaggaggccaagatgctcctggacaacatcaacacccccgaggggatcatcccgagcatgttcgagcccgagcgggagaaggtggacgccatcgacggcgagtaccgcctgcgcggcgaggcccggaagaccttcgtggacctcatgcgccgcggggacctgcccgtctggctggcctacaaggtggcggccgagggcatcaactacgccgaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgcggccgggcggaagtccctgacgctcaacctgatcaccgagatgggccgcctgcccaccttcatgacccagaagacgcgggacgccctcgacaacctggccgtgctgcacaccgcggaggccggcgggcgcgcctacaaccacgccctctccgagctgcccgagaccctggagaccctcctgctgctcacgctgctggccaccgtgaccggcgggatcttcctcttcctgatgagcggccggggcatcgggaagatgaccctgggcatgtgctgcatcatcaccgcgtccatcctcctgtggtacgcccagatccagccgcactggatcgccgccagcatcatcctggagttcttcctcatcgtcctgctgatccccgagcccgagaagcagcgcacgccccaggacaaccagctcacctacgtggtcatcgccatcctgaccgtggtggcggccaccatggccaacgagatggggttcctggagaagacgaagaaggacctcggcctggggtccatcgccacccagcagccggagagcaacatcctggacatcgacctccggcccgcctccgcgtggaccctgtacgccgtcgccaccacgttcatcacccccatgctgcgccacagcatcgagaacagctccgtgaacaccagcctcaccgccatcgccaaccaggcgacggtgctgatgggcctgggcaaggggtggcccctctccaagatggacatcggcgtcccgctgctggccatcgggtgctacagccaggtgaaccccatcaccctcaccgccgccctgctgctcctggtggcgcactacgccatcatcggccccgggctgcaggccaaggccacccgggaggcccagaagcgcgcggccgccggcatcatgaagaaccccacggtcgacggcatcaccgtgatcgacctcgacccgatcccctacgaccccaagttcgagaagcagctgggccaggtgatgctgctcatcctgtgcgtcacccaggtgctgatgatgcggaccacgtgggccctctgcgaggccctgaccctggcgaccggccccatctccaccctctgggaggggaacccgggccgcttctggaacacgaccatcgccgtgagcatggccaacatcttccgggggtcctacctggccggcgccggcctcctcttcagcatcatgaagaacaccaccaacacgcgccgcgggaccggcaacatcggggagaccctgggcgagaagtggaagtcccggctgaacgcgctcggcaagagcgagttccagatctacaagaagtccgggatccaggaggtcgaccgcaccctggccaaggagggcatcaagcgcggggagacggaccaccacgccgtgagccgcggctccgccaagctgcggtggttcgtggagcgcaacatggtcacccccgaggggaaggtggtggacctcggctgcggccgcggcgggtggagctactactgcggcgggctgaagaacgtcaaggaggtgaaggggctgaccaagggcgggcccgggcacgaggagcccatcccgatgtccacctacggctggaacctcgtgcgcctgcagagcggggtcgacgtgttcttcatcccgcccgagaagtgcgacacgctgctctgcgacatcggcgagtccagccccaacccgaccgtggaggcggggcggaccctgcgcgtcctgaacctcgtggagaactggctgaacaacaacacccagttctgcatcaaggtgctgaacccctacatgccctccgtcatcgagaagatggaggccctgcagcggaagtacggcggcgccctcgtgcgcaacccgctgagccggaacagcacccacgagatgtactgggtgtccaacgccagcgggaacatcgtctccagcgtgaacatgatctcccgcatgctgatcaaccggttcacgatgcgccacaagaaggccacctacgagcccgacgtggacctcggcagcgggacccggaacatcggcatcgagtccgaggtccccaacctggacatcatcgggaagcgcatcgagaagatcaagcaggagcacgagaccagctggcactacgaccaggaccacccctacaagacgtgggcgtaccacggctcctacgagaccaagcagaccggcagcgcctccagcatggtgaacggggtggtccggctgctcaccaagccgtgggacgtgctgcccacggtgacccagatggccatgaccgacaccacgcccttcggccagcagcgcgtcttcaaggagaaggtggacacccgcacccaggagcccaaggaggggaccaagaagctgatgaagatcacggccgagtggctctggaaggagctgggcaagaagaagaccccgcggatgtgcacccgcgaggagttcacccggaaggtgcgctccaacgccgcgctgggcgccatcttcacggacgagaacaagtggaagtccgcccgggaggccgtcgaggactcccgcttctgggagctcgtggacaaggagcggaacctgcacctggaggggaagtgcgagacctgcgtgtacaacatgatgggcaagcgcgagaagaagctcggggagttcggcaaggccaaggggagccgggcgatctggtacatgtggctgggcgcccgcttcctggagttcgaggccctcggcttcctgaacgaggaccactggttctcccgggagaacagcctgtccggggtcgagggcgaggggctccacaagctgggctacatcctgcgcgacgtgagcaagaaggagggcggggccatgtacgcggacgacaccgccggctgggacacccggatcacgctcgaggacctgaagaacgaggagatggtgaccaaccacatggagggggagcacaagaagctggccgaggccatcttcaagctcacctaccagaacaaggtcgtgcgcgtccagcggcccacgccccggggcacggtgatggacatcatcagccggcgcgaccagcgggggtccggccaggtggggacctacggcctgaacaccttcaccaacatggaggcccagctgatccgccagatggagggcgagggggtcttcaagaacatccagcacctcacggtgaccgaggaggtggcggtccagaactggctggcccgggtgggccgcgagcgcctgagccggatggccatctccggggacgactgcgtggtcaagcccctcgacgaccgcttcgccaacgccctgaccgcgctgaacgacatgggcaagatccggaaggacatccagcagtgggagccgagcaagggctggaacgactggacccaggtgcccttctgctcccaccacttccacgagctcatcatgaaggacgggcgcgtgctggtcgtgccctgccggaaccaggacgagctgatcggccgcgcccggatcagccagggggccggctggtccctccgcgagacggcctgcctgggcaagagctacgcccagatgtggtccctgatctacttccaccggcgcgacctccggctggcggccaacgccatctgcagcgccgtgccctcccactgggtcccgaccagccgcaccacctggtccatccacgccaagcacgagtggatgaccacggaggacatgctgaccgtgtggaaccgggtgtggatccgcgagaacccctggatggaggacaagacccccgtcgagagctgggaggagatcccctacctcggcaagcgggaggaccagtggtgcggctccctgatcgggctgaccagccgcgcgacgtgggccaagaacatccaggccgccatcaaccaggtgcggtccctcatcggcaacgaggagtacaccgactacatgccgagcatgaagcgcttccggcgcgaggaggaggaggcgggggtgctgtggtga

SEQ ID NO: 9173 - RNA, 9876 nt, synthetic construct
  misc_feature 1..9876: note = derived and/or modified CDS sequence (opt1) from DENV-2__GQ868623__SS-prME
  source 1..9876: mol_type = other RNA
agcgccggcatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacgcggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctgttcaccggccacctgaagtgccggctgcgcatggacaagctccagctgaaggggatgagctactccatgtgcacgggcaagttcaaggtggtgaaggagatcgccgagacccagcacgggaccatcgtcatccgggtgcagtacgagggcgacggcagcccctgcaagatccccttcgagatcatggacctggagaagcgctacgtgctcgggcggctgatcaccgtcaacccgatcgtgacggagaaggactcccccgtgaacatcgaggcggagccgcccttcggcgacagctacatcatcatcggggtcgagccgggccagctgaagctcaactggttcaagaaggggtccagcatcggccagatgttcgagaccaccatgcgcggcgccaagcgcatggccatcctgggggacaccgcctgggacttcggctccctcggcggggtgttcacgagcatcgggaaggccctccaccaggtgttcggcgcgatctacggcgccgccttctccggggtcagctggaccatgaagatcctgatcggcgtgatcatcacctggatcgggatgaactcccggagcacctccctgagcgtgtccctggtcctcgtgggcatcgtgacgctgtacctgggggtcatggtgcaggccgacagcggctgcgtggtctcctggaagaacaaggagctcaagtgcggcagcgggatcttcatcaccgacaacgtgcacacctggaccgagcagtacaagttccagcccgagagcccctccaagctggcgagcgccatccagaaggcccaggaggagggcatctgcgggatccgctccgtgacgcggctggagaacctcatgtggaagcagatcacccccgagctgaaccacatcctggccgagaacgaggtcaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtggaggactacggcttcggggtgttcaccaccaacatctggctcaagctgaaggagaagcaggacgccttctgcgactccaagctgatgagcgccgcgatcaaggacaaccgggccgtccacgccgacatgggctactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgcggggcccgtcagccagcacaactaccgcccgggctaccacacccagatcgccgggccctggcacctgggcaagctggagatggacttcgacttctgcgacgggaccaccgtgatcgtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtcaactccctcgtgaccgccgggcacggccaggtggacaacttcagcctgggcgtcctggggctcgcgctgttcctggaggagatgctccggacccgcgtgggcacgaagcacgccatcctgctggtggccgtctccttcgtgaccctcatcaccgggaacatgagcgtgaaggacctgggccgggtcgtggtgatggtcggggccaccatgacggacgacatcggcatgggcgtgacctacctggccctcctggcggccttcaaggtgcgccccaccttcgccgccgggctgctcctgcggaagctgacctccaaggagctcatgatgacgaccatcggcatcgtcctgctgagccagtccaccatccccgagaccatcctcgagctgacggacgccctggcgctcgggatgatggtgctgaagatcgtgcgcgacatggagaagtaccagctggccgtcaccatcatggccatcctctgcgtgccgaacgccgtcatcctgcagaacgcctggaaggtgagctgcaccatcctggcggtggtctccgtgagccccctcctgctgacctccagccagcagaagacggactggatccccctcgccctgaccatcaagggcctgaaccccaccgccatcttcctcaccacgctgtcccgcaccaacaagaagcggagctggccgctgaacgaggccatcatggcggtgggcatggtctccatcctcgccagctccctgctgaagaacgacatccccatgaccgggcccctcgtggccggcgggctgctgaccgtgtgctacgtcctcacgggccgcagcgccgacctggagctggagcgggccaccgacgtgaagtgggaggaccaggcggagatctccgggagcagccccatcctctccatcaccatcagcgaggacggctccatgagcatcaagaacgaggaggaggagcagaccctgacgatcctgatccgcaccggcctcctggtgatctccgggctgttcccggtcagcatccccatcaccgccgccgcctggtacctctgggaggtgaagaagcagcgggccggcgtgctgtgggacgtccccagcccgccgcccatggggaaggcggagctggaggacggcgcctaccgcatcaagcagaaggggatcctcggctacagccagatcggcgccggggtgtacaaggagggcaccttccacaccatgtggcacgtgacgcgcggggccgtcctgatgcacaagggcaagcgcatcgagccctcctgggccgacgtgaagaaggacctgatcagctacgggggcggctggaagctcgagggggagtggaaggagggcgaggaggtgcaggtcctggcgctggagcccgggaagaacccccgggccgtgcagaccaagcccggcctcttcaagaccaacaccgggacgatcggcgccgtgtccctggacttcagccccggcacctccgggagccccatcatcgacaagaagggcaaggtcgtggggctgtacggcaacggcgtggtcacccgctccggggcctacgtgagcgccatcgcgcagaccgagaagtccatcgaggacaaccccgagatcgaggacgacatcttccggaagcgccggctgacgatcatggacctccaccccggcgccgggaagaccaagcgctacctgcccgccatcgtgcgggaggccatcaagcgcggcctgcggaccctcatcctggcgccgacccgcgtcgtggccgccgagatggaggaggccctgcgggggctccccatccgctaccagacgcccgccatccgggcggagcacaccggccgcgagatcgtggacctgatgtgccacgccaccttcaccatgcgcctgctcagccccgtccgggtgccgaactacaacctgatcatcatggacgaggcccacttcacggaccccgcctccatcgccgcgcgcggctacatcagcacccgggtggagatgggggaggccgccggcatcttcatgaccgccacgccgcccgggagccgcgacccgttcccccagtccaacgcccccatcatcgacgaggagcgggagatccccgagcgcagctggaactccggccacgagtgggtcacggacttcaaggggaagaccgtgtggttcgtgccgagcatcaaggcgggcaacgacatcgccgcctgcctgcggaagaacggcaagaaggtcatccagctctcccgcaagaccttcgacagcgagtacgtgaagacccggacgaacgactgggacttcgtggtcaccaccgacatctccgagatgggggccaacttcaaggcggagcgcgtgatcgacccccggcgctgcatgaagcccgtgatcctgaccgacggcgaggagcgggtcatcctggccgggcccatgccggtgacgcacagctccgccgcccagcgccggggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtggacgccatcgacggggagtaccggctccgcggcgaggcccgcaagaccttcgtcgacctgatgcggcgcggggacctgcccgtgtggctcgcctacaaggtggccgcggagggcaccaactacgccgaccggcgctggtgcttcgacgggatcaagaacaaccagatcctggaggagaacgtcgaggtggagatctggacgaaggagggcgagcggaagaagctgaagccgcgctggctcgacgcccggatctactccgaccccctggccctgaaggagttcaaggagttcgccgcgggccgcaagagcctcaccctgaacctgatcaccgagatggggcggctccccaccttcatgacgcagaagacccgcgacgccctggacaacctggccgtcctccacaccgccgaggcgggcgggcgggcctacaaccacgccctgtccgagctgcccgagaccctcgagacgctgctgctcctgaccctgctcgccaccgtgaccggcggcatcttcctgttcctgatgagcgggcgcggcatcgggaagatgaccctcggcatgtgctgcatcatcacggcctccatcctgctgtggtacgcgcagatccagccgcactggatcgccgccagcatcatcctcgagttcttcctgatcgtgctgctcatccccgagcccgagaagcagcggacgccccaggacaaccagctgacctacgtcgtgatcgccatcctgaccgtggtcgccgcgacgatggccaacgagatggggttcctcgagaagaccaagaaggacctgggcctgggctccatcgccacccagcagccggagagcaacatcctcgacatcgacctgcgccccgcctccgcctggaccctgtacgcggtggccacgaccttcgtgacccccatgctccggcacagcatcgagaacagctccgtcaacgtgagcctgaccgccatcgccaaccaggccacggtgctgatggggctcggcaaggggtggcccctgtccaagatggacatcggcgtcccgctgctcgcgatcgggtgctacagccaggtgaaccccatcaccctgaccgccgccctgctcctgctggtggcccactacgcgatcatcggccccggcctccaggccaaggccacccgcgaggcccagaagcgggccgcggccgggatcatgaagaaccccacggtcgacggcatcaccgtgatcgacctggacccgatcccctacgaccccaagttcgagaagcagctgggccaggtgatgctcctgatcctgtgcgtcacccaggtgctcatgatgcgcaccacgtgggccctgtgcgaggccctgaccctcgccaccggccccatctccaccctgtgggaggggaacccgggccggttctggaacacgaccatcgcggtgagcatggccaacatcttccgcggctcctacctggccggggccggcctcctgttcagcatcatgaagaacaccaccaacacgcggcgcgggaccggcaacatcggcgagaccctgggggagaagtggaagtcccgcctcaacgccctgggcaagagcgagttccagacctacaagaagtccgggatccaggaggtcgaccggacgctggcgaaggagggcatcaagcgcggggagaccgaccaccacgccgtgagccggggctccgccaagctccgctggttcgtggagcggaacatggtcacccccgagggcaaggtggtggacctggggtgcggccgcgggggctggagctactactgcgggggcctgaagaacgtccgggaggtgaagggcctcaccaagggcgggcccgggcacgaggagcccatcccgatgtccacgtacggctggaacctggtgcgcctgcagagcggggtcgacgtgttcttcatcccgcccgagaagtgcgacaccctcctgtgcgacatcggcgagtccagccccaacccgaccgtggaggccggccggaccctgcgcgtcctcaacctggtggagaactggctgaacaacaacacccagttctgcatcaaggtgctgaacccctacatgccctccgtcatcgagaagatggaggcgctccagcggaagcacgggggcgccctggtgcgcaacccgctgagccggaacagcacgcacgagatgtactgggtgtccaacgccagcgggaacatcgtctccagcgtgaacatgatctcccgcatgctcatcaaccggttcaccatgcgccacaagaaggccacctacgagcccgacgtggacctgggcagcgggacccggaacatcggcatcgagtccgagatccccaacctggacatcatcggcaagcgcatcgagaagatcaagcaggagcacgagacgagctggcactacgaccaggaccacccctacaagacctgggcctaccacgggtcctacgagaccaagcagaccggcagcgcgtccagcatggtcaacggggtggtgcggctcctgacgaagccgtgggacgtcctgcccaccgtgacccagatggccatgaccgacacgacccccttcggccagcagcgcgtgttcaaggagaaggtcgacacccgcacccaggagcccaaggagggcacgaagaagctcatgaagatcaccgccgagtggctgtggaaggagctggggaagaagaagaccccgcggatgtgcacccgcgaggagttcacgcggaaggtgcgctccaacgccgccctcggcgcgatcttcaccgacgagaacaagtggaagtccgcccgggaggccgtggaggactcccgcttctgggagctggtcgaccgggagcgcaacctgcacctcgaggggaagtgcgagacctgcgtgtacaacatgatgggcaagcgggagaagaagctgggggagttcggcaaggccaagggcagccgcgccatctggtacatgtggctgggggcgcggttcctcgagttcgaggccctgggcttcctgaacgaggaccactggttctcccgcgagaacagcctctccggggtcgagggcgaggggctgcacaagctgggctacatcctccgggacgtgagcaagaaggagggcggggccatgtacgccgacgacaccgcgggctgggacacgcgcatcaccctggaggacctgaagaacgaggagatggtgaccaaccacatggagggggagcacaagaagctcgccgaggccatcttcaagctgacctaccagaacaaggtcgtgcgggtgcagcgccccacgccccggggcaccgtcatggacatcatcagccgccgggaccagcgcgggtccggccaggtgggcacctacgggctgaacaccttcacgaacatggaggcccagctcatccggcagatggagggcgagggggtgttcaagaacatccagcacctgaccgccaccgaggaggtcgcggtgcagaactggctggcccgcgtgggccgcgagcggctcagccgcatggccatctccggcgacgactgcgtcgtgaagcccctggacgaccggttcgccaacgccctgaccgcgctcaacgacatggggaagatccgcaaggacatccagcagtgggagccgagcaagggctggaacgactggacccaggtgcccttctgctcccaccacttccacgagctgatcatgaaggacgggcgggtcctggtggtgccctgccgcaaccaggacgagctcatcggccgggcccgcatcagccagggggccggctggtccctgcgggagaccgcctgcctgggcaagagctacgcccagatgtggtccctcatgtacttccaccgccgggacctgcgcctggcggccaacgccatctgcagcgccgtcccctcccactgggtgccgaccagccggaccacctggtccatccacgccaagcacgagtggatgacgaccgaggacatgctcaccgtgtggaaccgcgtctggatccgggagaacccctggatggaggacaagacccccgtggagagctgggaggagatcccctacctggggaagcgcgaggaccagtggtgcggctccctgatcgggctcacgagccgggcgacctgggccaagaacatccaggccgccatcaaccaggtgcgctccctgatcggcaacgaggagtacaccgactacatgccgagcatgaagcggttccgccgcgaggaggaggaggcgggggtcctgtggtga

SEQ ID NO: 9174 - RNA, 9876 nt, synthetic construct
  misc_feature 1..9876: note = derived and/or modified CDS sequence (opt1) from DENV-2__GQ868624__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaaggaggagcacgagaccagctggcactacgaccaggaccacccctacaagacctgggcctaccacggctcctacgagaccaagcagacggggagcgcgtccagcatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtggggacctacggcctgaacacgttcaccaacatggaggcccagctgatccgccagatggagggggagggcgtgttcaagaacatccagcacctcaccgtcaccgaggaggccgcggtgcagaactggctggcccgggtggggcgcgagcgcctgagccggatggccatctccggcgacgactgcgtcgtgaagcccctcgacgaccgcttcgccaacgccctgacggcgctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcccggatcagccagggcgccgggtggtccctccgcgagaccgcctgcctgggcaagagctacgcccagatgtggtccctgatgtacttccaccggcgcgacctccggctggcggccaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgcgacctgggccaagaacatccaggccgccatcaaccaggtgcggtccctcatcgggaacgaggagtacaccgactacatgccgagcatgaagcgcttccggcgcgaggaggaggaggcgggcgtcctgtggtga

SEQ ID NO: 9175 - RNA, 9876 nt, synthetic construct
  misc_feature 1..9876: note = derived and/or modified CDS sequence (opt1) from DENV-2__FJ639717__SS-prME
  source 1..9876: mol_type = other RNA
agcgccggcatgatcatcatgctgatccccaccgtgatggccttccacctcaccacccgcaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagtccaaggcctggctcgtgcaccgccagtggttcctggacctgcccctcccctggctgccgggggccgacaagcagggcagcaactggatccagaaggagaccctggtgaccttcaagaacccccacgcgaagaagcaggacgtcgtggtcctcgggagccaggagggcgccatgcacacggccctgaccggggccaccgagatccagatgtccagcggcaacctcctgttcaccggccacctgaagtgccggctgcgcatggacaagctccagctgaaggggatgtcctacagcatgtgcacgggcaagttcaaggtggtgaaggagatcgccgagacccagcacgggaccatcgtcatccgggtgcagtacgagggcgacggctccccctgcaagatccccttcgagatcatggacctggagaagcgctacgtgctcgggcggctgatcaccgtcaacccgatcgtgacggagaaggacagccccgtgaacatcgaggcggagccgcccttcggcgactcctacatcatcatcggggtcgagccgggccagctgaagctcaactggttcaagaaggggagctccatcggccagatgttcgagaccaccatgcgcggcgccaagcgcatggccatcctgggggacaccgcctgggacttcggcagcctcggcggggtgttcacgtccatcgggaaggccctccaccaggtgttcggggcgatctacggcgccgccttcagcggggtctcctggaccatgaagatcctgatcggcgtgatcatcacctggatcgggatgaacagccggtccaccagcctgtccgtgagcctggtcctcgtgggcatcgtgacgctgtacctgggggtcatggtgcaggccgactccggctgcgtggtcagctggaagaacaaggagctcaagtgcggcagcgggatcttcatcaccgacaacgtgcacacctggaccgagcagtacaagttccagcccgagtcccccagcaagctggcgtccgccatccagaaggcccaggaggagggcatctgcgggatccgcagcgtgacgcggctggagaacctcatgtggaagcagatcacccccgagctgaaccacatcctggccgagaacgaggtcaagctcaccatcatgaccggcgacatcaaggggatcatgcaggccggcaagcgctccctgcggccgcagcccacggagctgaagtacagctggaagacctggggcaaggcgaagatgctctccaccgagagccacaaccagaccttcctgatcgacgggcccgagacggccgagtgcccgaacaccaaccgcgcctggaactccctggaggtggaggactacggcttcggggtgttcaccaccaacatctggctcaagctgaaggagaagcaggacgccttctgcgacagcaagctgatgtccgccgcgatcaaggacaaccgggccgtccacgccgacatgggctactggatcgagagcgccctcaacgacacgtggaagatcgagaaggcctccttcatcgaggtgaagaactgccactggcccaagagccacaccctgtggtccaacggcgtgctggagagcgagatgatcatccccaagaacctcgcggggcccgtctcccagcacaactaccgcccgggctaccacacccagaccgccgggccctggcacctgggcaagctggagatggacttcgacttctgcgacgggaccacggtgatcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccaggtggacaacttctccctgggcgtcctggggatggccctgttcctggaggagatgctgcggacgcgcgtgggcaccaagcacgccatcctcctggtggccgtcagcttcgtgaccctgatcaccgggaacatgtccttcaaggacctcggccgggtggtcgtgatggtggggacgaccatgaccgacgacatcggcatgggcgtcacctacctggccctgctcgccgcgttcaaggtgcgccccacgttcgccgccgggctgctgctccggaagctgaccagcaaggagctgatgatgaccaccatcggcatcgtgctcctgtcccagagcacgatccccgagaccatcctggagctcaccgacgccctggccctggggatgatggtcctcaagatcgtgcgcgacatggagaagtaccagctggcggtgaccatcatggccatcctgtgcgtcccgaacgccgtgatcctccagaacgcctggaaggtctcctgcacgatcctggccgtggtgagcgtcagccccctgctcctgaccagctcccagcagaagaccgactggatccccctggcgctcaccatcaagggcctgaaccccacggccatcttcctgaccaccctcagccgcaccaacaagaagcggtcctggccgctgaacgaggccatcatggccgtgggcatggtgagcatcctggcgtccagcctcctgaagaacgacatccccatgacggggcccctggtcgccggcgggctcctgaccgtgtgctacgtgctgaccggccgctccgccgacctcgagctggagcgggccaccgacgtcaagtgggaggaccaggccgagatcagcgggagctcccccatcctgagcatcacgatctccgaggacggcagcatgtccatcaagaacgaggaggaggagcagaccctcaccatcctgatccgcaccggcctgctcgtgatcagcgggctgttcccggtgtccatccccatcaccgcggccgcctggtacctgtgggaggtcaagaagcagcgggccggcgtgctctgggacgtgccctccccgccgcccatggggaaggccgagctggaggacggcgcgtaccgcatcaagcagaaggggatcctgggctactcccagatcggcgccggggtctacaaggagggcacgttccacaccatgtggcacgtgacccgcggggcggtgctcatgcacaagggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagaccaagcccggcctgttcaagacgaacaccgggaccatcggcgccgtgagcctcgacttctcccccggcaccagcgggtcccccatcatcgacaagaagggcaaggtggtcgggctgtacggcaacggcgtggtgacgcgcagcggggcctacgtctccgccatcgcccagaccgagaagtccatcgaggacaaccccgagatcgaggacgacatcttccggaagcgccggctgaccatcatggacctgcaccccggcgcggggaagaccaagcgctacctccccgccatcgtgcgggaggccatcaagcgcggcctgcggacgctgatcctcgccccgacccgcgtggtcgcggccgagatggaggaggccctgcgggggctgcccatccgctaccagacccccgccatccgggccgagcacaccggccgcgagatcgtggacctcatgtgccacgcgacgttcaccatgcgcctgctgtcccccgtgcgggtcccgaactacaacctcatcatcatggacgaggcccacttcaccgaccccgccagcatcgccgcccgcggctacatcagcacccgggtggagatgggggaggcggccggcatcttcatgacggccacgccgcccgggtcccgcgacccgttcccccagagcaacgcccccatcatcgacgaggagcgggagatccccgagcgctcctggaacaccggccacgagtgggtgaccgacttcaaggggaagacggtctggttcgtgccgagcatcaaggccggcaacgacatcgcggcctgcctgcggaagaacggcaagaaggtgatccagctgtcccgcaagaccttcgacagcgagtacgtcaagacccggaccaacgactgggacttcgtggtgacgaccgacatctccgagatgggggccaacttcaaggccgagcgcgtcatcgacccccggcgctgcatgaagcccgtgatcctcaccgacggcgaggagcgggtgatcctggcggggcccatgccggtcacccacagctccgccgcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgcgagaaggtggacgcgatcgacggggagtaccggctgcgcggcgaggcccgcaagaccttcgtggacctcatgcggcgcggggacctgcccgtctggctggcctacaaggtggccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctactccgaccccctcgccctgaaggagttcaaggagttcgccgccggccgcaagagcctgaccctcaacctgatcacggagatggggcggctgcccaccttcatgacccagaagacccgcgacgcgctcgacaacctggccgtgctgcacacggccgaggccggcgggcgggcgtacaaccacgccctctccgagctgcccgagaccctggagaccctcctgctgctcaccctgctggccaccgtcacgggcggcatcttcctcttcctgatgagcgggcgcggcatcgggaagatgaccctgggcatgtgctgcatcatcaccgcctccgtgctcctgtggtacgcccagatccagccgcactggatcgcggccagcatcatcctggagttcttcctcatcgtgctgctgatccccgagcccgagaagcagcggacgccccaggacaaccagctcacgtacgtcgtgatcgccatcctgaccgtggtcgccgccaccatggcgaacgagatggggttcctggagaagaccaagaaggacctcggcctgggctccatcgccacgcagcagccggagagcaacatcctggacatcgacctccgccccgcctccgcctggaccctgtacgccgtggcgaccaccttcgtgacgcccatgctgcggcacagcatcgagaacagctccgtcaacgtgagcctcaccgccatcgccaaccaggccaccgtgctgatggggctgggcaaggggtggcccctctccaagatggacatcggcgtcccgctgctggccatcgggtgctacagccaggtgaaccccatcaccctcacggcggccctgctgctcctggtggcccactacgccatcatcggccccggcctgcaggcgaaggccacccgcgaggcccagaagcgggccgccgcggggatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacgggccccatctccaccctctgggaggggaacccgggccggttctggaacaccaccatcgccgtgagcatggcgaacatcttccgcggctcctacctggccggggccggcctcctcttcagcatcatgaagaacacgaccaacacccggcgcgggaccggcaacatcggcgagacgctgggggagaagtggaagtcccgcctgaacgccctcggcaagagcgagttccagacctacaagaagtccgggatccaggaggtcgaccggaccctggccaaggagggcatcaagcgcggggagaccgaccaccacgcggtgagccggggctccgccaagctgcgctggttcgtggagcggaacatggtcacgcccgagggcaaggtggtggacctcgggtgcggccgcgggggctggagctactactgcgggggcctgaagaacgtccgggaggtgaagggcctgaccaagggcgggcccgggcacgaggagcccatcccgatgtccacctacggctggaacctcgtgcgcctgcagagcggggtcgacgtgttcttcatcccgcccgagaagtgcgacaccctgctctgcgacatcggcgagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggccctgcagcggaagtacgggggcgcgctcgtgcgcaacccgctgagccggaacagcacccacgagatgtactgggtgtccaacgccagcgggaacatcgtctccagcgtgaacatgatctcccgcatgctgatcaaccggttcaccatgcgccacaagaaggccacgtacgagcccgacgtggacctcggcagcgggacccggaacatcggcatcgagtccgagatccccaacctggacatcatcggcaagcgcatcgagaagatcaagcaggagcacgagaccagctggcactacgaccaggaccacccctacaagacctgggcctaccacgggtcctacgagacgaagcagaccggcagcgcctccagcatggtcaacggggtggtgcggctgctcaccaagccgtgggacgtcctgcccaccgtgacgcagatggcgatgaccgacaccacccccttcggccagcagcgcgtgttcaaggagaaggtcgacacgcgcacccaggagcccaaggagggcaccaagaagctgatgaagatcaccgccgagtggctctggaaggagctggggaagaagaagacgccgcggatgtgcacccgcgaggagttcacccggaaggtgcgctccaacgccgccctgggcgccatcttcaccgacgagaacaagtggaagtccgcgcgggaggccgtggaggactcccgcttctgggagctcgtcgacaaggagcggaacctgcacctggaggggaagtgcgagacgtgcgtgtacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggagaacagcctgtccggggtcgagggcgaggggctccacaagctgggctacatcctgcgcgacgtgagcaagaaggagggcggggccatgtacgccgacgacaccgccggctgggacacccggatcaccctcgaggacctgaagaacgaggagatggtgacgaaccacatggagggggagcacaagaagctggcggaggccatcttcaagctcacctaccagaacaaggtcgtgcgcgtgcagcggcccacgccccggggcaccgtcatggacatcatcagccggcgcgaccagcgggggtccggccaggtgggcacgtacgggctgaacaccttcaccaacatggaggcccagctgatccgccagatggagggcgagggggtgttcaagaacatccagcacctcaccgccacggaggaggtcgccgtgcagaactggctggcgcgggtgggccgcgagcgcctgagccggatggccatctccggcgacgactgcgtcgtgaagcccctcgacgaccgcttcgccaacgccctgaccgccctgaacgacatggggaagatccggaaggacatccagcagtgggagccgagcaagggctggaacgactggacccaggtgcccttctgctcccaccacttccacgagctcatcatgaaggacgggcgcgtcctggtggtgccctgccggaaccaggacgagctgatcggccgcgcgcggatcagccagggggccggctggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgacggtgtggaaccgggtctggatccgcgagaacccctggatggaggacaagacccccgtggagagctgggaggagatcccctacctcgggaagcgggaggaccagtggtgcggctccctgatcgggctgaccagccgcgccacctgggcgaagaacatccaggccgccatcaaccaggtgcggtccctcatcggcaacgaggagtacacggactacatgccgagcatgaagcgcttccggcgcgaggaggaggaggccggggtcctgtggtga

SEQ ID NO: 9176 - RNA, 9876 nt, synthetic construct
  misc_feature 1..9876: note = derived and/or modified CDS sequence (opt1) from DENV-2__FJ639718__SS-prME
  source 1..9876: mol_type = other RNA
agcgcggggatgatcatcatgctgatccccaccgtgatggccttccacctcaccacccggaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagaaggccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgggagatcgtggacctcatgtgccacgccaccttcaccatgcgcctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccgcaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccggggcaccgggaacatcggcgagacgctgggcgagaagtggaagtcccgcctgaacgccctcggcaagagcgagttccagatctacaagaagtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaaggaggagcacgagaccagctggcactacgaccaggaccacccctacaagacctgggcctaccacggctcctacgagaccaagcagacggggagcgcgtccagcatggtcaacggcgtggtgcgcctgctcaccaagccgtgggacgtcctgcccaccgtgacccagatggccatgacggacaccacccccttcgggcagcagcgggtgttcaaggagaaggtcgacacccgcacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggcgatcttcaccgacgagaacaagtggaagtccgcccgcgaggccgtggaggacaaccggttctgggagctcgtcgacaaggagcgcaacctgcacctggagggcaagtgcgagacctgcgtgtacaacatgatggggaagcgggagaagaagctcggcgagttcgggaaggccaagggctcccgcgccatctggtacatgtggctgggcgcgcggttcctggagttcgaggccctcgggttcctgaacgaggaccactggttcagccgcgagaactccctgagcggcgtcgagggggagggcctccacaagctggggtacatcctgcgggacgtgtccaagaaggagggcggcgccatgtacgccgacgacacggcggggtgggacacccgcatcaccctcgaggacctgaagaacgaggagatggtgaccaaccacatggagggcgagcacaagaagctggccgaggccatcttcaagctcacgtaccagaacaaggtcgtgcgggtgcagcgccccacgccccgggggaccgtcatggacatcatcagccgccgggaccagcgcggcagcggccaggtggggacctacggcctgaacacgttcaccaacatggaggcccagctgatccggcagatggagggggagggcgtgttcaagaacatccagcacctcaccgtcaccgaggaggccgcggtgcagaactggctggcccgcgtggggcgggagcgcctgtcccgcatggccatcagcggcgacgactgcgtcgtgaagcccctcgacgaccggttcgccaacgccctgacggcgctgaacgacatgggcaagatccgcaaggacatccagcagtgggagccgtccaaggggtggaacgactggacccaggtgcccttctgcagccaccacttccacgagctcgtcatgaaggacggccgggtgctggtggtcccctgccgcaaccaggacgagctgatcgggcgggcccgcatctcccagggcgccgggtggagcctccgggagaccgcctgcctgggcaagtcctacgcccagatgtggagcctgatgtacttccaccgccgggacctccgcctggcggccaacgccatctgctccgccgtgcccagccactgggtgccgacctcccggacgacctggagcatccacgccaagcacgagtggatgaccaccgaggacatgctgaccgtctggaaccgcgtgtggatccgggagaacccctggatggaggacaagacgcccgtggagtcctgggaggagatcccctacctcggcaagcgcgaggaccagtggtgcgggagcctgatcggcctgacctcccgggcgacctgggccaagaacatccaggccgccatcaaccaggtccgcagcctcatcgggaacgaggagtacaccgactacatgccgtccatgaagcggttccgccgggaggaggaggaggcgggcgtgctgtggtga

SEQ ID NO: 9177 - RNA, 9876 nt, synthetic construct
  misc_feature 1..9876: note = derived and/or modified CDS sequence (opt1) from DENV-2__GQ868625__SS-prME
  source 1..9876: mol_type = other RNA
agcgcggggatgatcatcatgctgatccccaccgtgatggccttccacctcaccacccgcaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcgcatgttcgagaccaccatgcgcggcgcgaagcggatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccgcagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccggtccgtcacgcgcctggagaacctcatgtggaagcagatcacccccgagctgaaccacatcctggccgagaacgaggtgaagctcaccatcatgaccggggacatcaagggcatcatgcaggccgggaagcggagcctgcgcccgcagcccacggagctgaagtactcctggaagacctggggcaaggccaagatgctcagcaccgagtcctacaaccagaccttcctgatcgacggccccgagacggcggagtgcccgaacaccaaccgggcctggaacagcctggaggtggaggactacgggttcggcgtcttcaccaccaacatctggctcaagctgaaggagaagcaggacgccttctgcgactccaagctgatgagcgccgccatcaaggacaaccgcgcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccggccggggtaccacacccagatcgcgggcccctggcacctggggaagctggagatggacttcgacttctgcgacggcaccaccgtgatcgtcacggaggactgcgggaaccgcggcccctccctccggaccaccaccgccagcggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcaggtcgacaacttcagcctgggcgtgctgggcatggccctcttcctggaggagatgctgcgcacccgggtggggacgaagcacgcgatcctcctggtcgccgtgtccttcgtgaccctgatcaccggcaacatgagcttcaaggacctcgggcgcgtcgtggtgatggtcggcgccaccatggccgacgacatcgggatgggcgtgacgtacctggccctgctcgcggccttcaaggtgcggcccaccttcgccgccggcctgctgctccgcaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccggacgaacaagaagcgcagctggccgctgaacgaggccatcatggcggtcggcatggtgtccatcctggccagctccctcctgaagaacgacatccccatgaccggccccctggtggccgggggcctcctgaccgtctgctacgtgctgaccgggcggagcgccgacctcgagctggagcgcgccacggacgtgaagtgggaggaccaggcggagatctccggcagcagccccatcctgtccatcaccatcagcgaggacgggtccatgagcatcaagaacgaggaggaggagcagaccctcaccatcctgatccggacgggcctgctcgtcatctccggcctgttcccgatcagcatccccatcaccgccgccgcctggtacctgtgggaggtgaagaagcagcgcgccggggtgctctgggacgtccccagcccgccgcccatgggcaaggcggagctggaggacggggcctaccggatcaagcagaagggcatcctggggtacagccagatcggcgccggcgtgtacaaggaggggaccttccacaccatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccggtccggcgcctacgtgagcgccatcgcgcagaccgagaagtccatcgaggacaaccccgagatcgaggacgacatcttccgcaagcggcgcctgaccatcatggacctgcaccccggggccggcaagacgaagcggtacctccccgccatcgtgcgcgaggccatcaagcgggggctgcgcaccctgatcctcgcgccgacccgggtcgtggccgccgagatggaggaggccctgcgcggcctgcccatccggtaccagacccccgccatccgcgcggagcacacggggcgcgagatcgtggacctcatgtgccacgccaccttcaccatgcggctgctgagccccgtccgcgtgccgaactacaacctcatcatcatggacgaggcccacttcaccgaccccgcctccatcgccgcgcggggctacatcagcacgcgcgtggagatgggcgaggccgccgggatcttcatgaccgccacgccgcccggcagccgggacccgttcccccagtccaacgcccccatcatcgacgaggagcgcgagatccccgagcggagctggaactccgggcacgagtgggtcaccgacttcaagggcaagacggtgtggttcgtgccgagcatcaaggcggggaacgacatcgccgcctgcctgcgcaagaacggcaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggggaggagcgcgtcatcctggccggccccatgccggtgacccacagctccgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgggagaaggtggacgccatcgacggcgagtaccgcctgcgcggggaggcccggaagaccttcgtcgacctcatgcgccggggcgacctgcccgtgtggctggcctacaaggtggccgcggaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctactccgaccccctcgccctgaaggagttcaaggagttcgccgcgggccggaagtccctgaccctcaacctgatcacggagatgggccgcctgcccaccttcatgacccagaagacccgggacgccctcgacaacctggccgtcctgcacacggccgaggccggcgggcgcgcctacaaccacgccctctccgagctgcccgagaccctggagaccctcctgctgctcaccctgctggccacggtgaccgggggcatcttcctcttcctgatgagcggccgggggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgggaggcccagaagcgcgccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacggggcccatctccaccctctgggagggcaacccggggcgcttctggaacaccaccatcgcggtgagcatggccaacatcttccggggctcctacctggccggcgccgggctcctcttcagcatcatgaagaacacgaccaacacccgccgcggcaccgggaacatcggcgagacgctgggcgagaagtggaagtcccggctgaacgccctcggcaagagcgagttccagatctacaagaagtccggcatccaggaggtcgaccgcaccctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggcccggccacgaggagcccatcccgatgtccacctacgggtggaacctcgtgcggctgcagagcggcgtcgacgtgttcttcatcccgcccgagaagtgcgacaccctgctctgcgacatcggggagtccagccccaacccgaccgtggaggccggccgcacgctgcgggtcctgaacctcgtggagaactggctgaacaacaacacccagttctgcatcaaggtgctgaacccctacatgccctccgtcatcgagaagatggaggcgctgcagcgcaagtacggcggggccctcgtgcggaacccgctgagccgcaacagcacccacgagatgtactgggtgtccaacgccagcggcaacatcgtctccagcgtgaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaaggaggagcacgagaccagctggcactacgaccaggaccacccctacaagacctgggcctaccacggctcctacgagaccaagcagacggggagcgcgtccagcatggtcaacggcgtggtgcgcctgctcaccaagccgtgggacgtcctgcccaccgtgacccagatggccatgacggacaccacccccttcgggcagcagcgcgtgttcaaggagaaggtcgacacccggacgcaggagcccaaggagggcaccaagaagctgatgaagatcaccgccgagtggctctggaaggagctgggcaagaagaagaccccgcgcatgtgcacgcgggaggagttcacccgcaaggtgcggtccaacgccgccctgggggcgatcttcaccgacgagaacaagtggaagtccgcccgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcgcggttcctggagttcgaggccctcgggttcctgaacgaggaccactggttctcccgcgagaacagcctgtccggcgtcgagggggagggcctccacaagctggggtacatcctgcgggacgtgagcaagaaggagggcggcgccatgtacgccgacgacacggcggggtgggacacccgcatcaccctcgaggacctgaagaacgaggagatggtgaccaaccacatggagggcgagcacaagaagctggccgaggccatcttcaagctcacgtaccagaacaaggtcgtgcgggtgcagcgccccacgccccgggggaccgtcatggacatcatcagccgccgggaccagcgcggctccggccaggtgggcacctacggcctgaacacgttcaccaacatggaggcccagctgatccggcagatggagggggagggcgtgttcaagaacatccagcacctcaccgtcaccgaggaggccgcggtgcagaactggctggcccgcgtggggcgcgagcggctgagccgcatggccatctccggcgacgactgcgtcgtgaagcccctcgacgaccggttcgccaacgccctgacggcgctgaacgacatgggcaagatccgcaaggacatccagcagtgggagccgagcaaggggtggaacgactggacccaggtgcccttctgctcccaccacttccacgagctcgtcatgaaggacggccgggtgctggtggtcccctgccgcaaccaggacgagctgatcgggcgggcccgcatcagccagggcgccgggtggtccctccgggagaccgcctgcctgggcaagagctacgcccagatgtggtccctgatgtacttccaccgccgggacctccgcctggcggccaacgccatctgcagcgccgtgccctcccactgggtgccgaccagccggacgacctggtccatccacgccaagcacgagtggatgaccaccgaggacatgctgaccgtctggaaccgcgtgtggatccgggagaacccctggatggaggacaagacgcccgtggagagctgggaggagatcccctacctcggcaagcgcgaggaccagtggtgcgggtccctgatcggcctgaccagccgggcgacctgggccaagaacatccaggccgccatcaaccaggtccgctccctcatcgggaacgaggagtacaccgactacatgccgagcatgaagcggttccgccgcgaggaggaggaggcgggcgtgctgtggtga

SEQ ID NO: 9178 - RNA, 9876 nt, synthetic construct
  misc_feature 1..9876: note = derived and/or modified CDS sequence (opt1) from DENV-2__KF955401__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgagcagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcatggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgtggcgttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgccatccagaaggcgcaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctgttcaccgagagctacaaccagaccttcctgatcgacggccccgagacggccgagtgcccgaacaccaaccgcgcgtggaactccctggaggtcgaggactacgggttcggcgtgttcaccaccaacatctggctcaagctgaaggagaagcaggacgccttctgcgacagcaagctgatgtccgccgccatcaaggacaaccgggccgtgcacgcggacatggggtactggatcgagagcgccctcaacgacacgtggaagatcgagaaggcctccttcatcgaggtcaagaactgccactggcccaagagccacaccctgtggtccaacggcgtgctggagagcgagatgatcatccccaagaacctcgccggccccgtgtcccagcacaactaccgcccggggtaccacacccagatcgccggcccctggcacctggggaagctggagatggacttcgacttctgcgacggcaccaccgtcatcgtgacggaggactgcgggaaccggggccccagcctccgcaccaccaccgcgtccggcaagctgatcacggagtggtgctgccggagctgcaccctgcccccgctccgctaccgcggggaggacggctgctggtacgggatggagatccgccccctgaaggagaaggaggagaacctggtgaacagcctcgtcaccgccggccacggccaggtggacaacttctccctgggcgtgctgggcatggccctcttcctggaggagatgctgcggacccgcgtcgggacgaagcacgccatcctcctggtggcggtgagcttcgtcaccctgatcaccggcaacatgtccttcaaggacctcgggcgggtggtggtcatggtgggcgccaccatggccgacgacatcgggatgggcgtgacgtacctggccctgctcgccgcgttcaaggtccgccccaccttcgccgccggcctgctgctccggaagctgaccagcaaggagctgatgatgaccacgatcgggatcgtgctcctgtcccagagcaccatccccgagaccgtgctggagctcaccgacgccctggccctgggcatgatggtcctcaagatcgtgcgcaacatggagaagtaccagctggcggtcacgatcatggccatcctgtgcgtgccgaacgccgtgatcctccagaacgcctggaaggtctcctgcaccatcctggccgtggtgagcgtcagccccctcctcctgaccagctcccagcagaagaccgactggatccccctggcgctcacgatcaaggggctgaaccccaccgccatcttcctgaccaccctcagccgcacgaacaagaagcggtcctggccgctgaacgaggccatcatggccgtgggcatggtgagcatcctggcgtccagcctcctgaagaacgacatccccatgaccggccccctggtcgccgggggcctcctgaccgtgtgctacgtgctgaccgggcgctccgccgacctcgagctggagcgggccacggacgtcaagtgggaggaccaggccgagatcagcggctccagccccatcctgagcatcaccatctccgaggacgggagcatgtccatcaagaacgaggaggaggagcagaccctcaccatcctgatccgcacgggcctgctcgtgatcagcggcctgttcccgatctccatccccatcaccgcggccgcctggtacctgtgggaggtgaagaagcagcgggccggggtcctctgggacgtgccctccccgccgcccatgggcaaggccgagctggaggacggggcgtaccgcatcaagcagaagggcatcctggggtactcccagatcggcgccggcgtgtacaaggaggggaccttccacaccatgtggcacgtcacccggggcgccgtgctcatgcacaaggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagacgaagcccgggctgttcaagaccaacaccggcaccatcggggccgtcagcctcgacttctcccccggcacgagcggctcccccatcatcgacaagaaggggaaggtggtgggcctgtacgggaacggcgtcgtgacccgcagcggcgcctacgtgtccgccatcgcccagaccgagaagtccatcgaggacaaccccgagatcgaggacgacatcttccggaagcgccggctgaccatcatggacctgcaccccggggcgggcaagacgaagcgctacctccccgccatcgtccgggaggccatcaagcgcgggctgcggaccctgatcctcgccccgacccgcgtggtggcggccgagatggaggaggccctgcggggcctgcccatccgctaccagacccccgccatccgggccgagcacacggggcgcgagatcgtcgacctcatgtgccacgcgaccttcaccatgcgcctgctgtcccccgtgcgggtgccgaactacaacctcatcatcatggacgaggcccacttcaccgaccccgccagcatcgccgcccgcggctacatctccacgcgggtcgagatgggcgaggcggccgggatcttcatgaccgccacgccgcccggcagccgcgacccgttcccccagagcaacgcccccatcatcgacgaggagcgggagatccccgagcgctcctggaacagcgggcacgagtgggtgaccgacttcaagggcaagacggtgtggttcgtcccgtccatcaaggccgggaacgacatcgcggcctgcctgcggaagaacggcaagaaggtgatccagctgagccgcaagaccttcgactccgagtacgtgaagacccggaccaacgactgggacttcgtcgtgacgaccgacatcagcgagatgggcgccaacttcaaggccgagcgcgtgatcgacccccggcgctgcatgaagcccgtcatcctcaccgacggggaggagcgggtgatcctggcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctcctggacaacatcaacacgcccgagggcatcatcccgtccatgttcgagcccgagcgcgagaaggtcgacgcgatcgacggcgagtaccggctgcgcggggaggcccgcaagaccttcgtggacctcatgcggcgcggcgacctgcccgtgtggctggcctacaaggtcgccgccgaggggatcaactacgcggaccggcgctggtgcttcgacggcatcaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgccgccggccgcaagtccctgaccctcaacctgatcacggagatgggccggctgcccaccttcatgacccagaagacccgcgacgcgctcgacaacctggccgtgctgcacacggccgaggccgggggccgggcgtacaaccacgccctcagcgagctgcccgagaccctggagaccctcctgctgctcaccctgctggccacggtgaccgggggcatcttcctcttcctgatgtccggccgcgggatcggcaagatgaccctggggatgtgctgcatcatcaccgccagcatcctcctgtggtacgcccagatccagccgcactggatcgcggcctccatcatcctggagttcttcctcatcgtcctgctgatccccgagcccgagaagcagcggacgccccaggacaaccagctcacgtacgtggtgatcgccatcctgaccgtcgtggccgccaccatggcgaacgagatgggcttcctggagaagaccaagaaggacctcgggctgggcagcatcgccacgcagcagccggagtccaacatcctggacatcgacctccgccccgccagcgcctggaccctgtacgccgtggcgaccaccttcgtcacgcccatgctgcggcactccatcgagaacagcagcgtgaacgtgtccctcaccgccatcgccaaccaggccaccgtcctgatgggcctggggaagggctggcccctcagcaagatggacatcggggtgccgctgctggccatcggctgctactcccaggtgaaccccatcaccctcacggcggccctgctgctcctggtcgcccactacgccatcatcgggcccggcctgcaggcgaaggccacccgcgaggcccagaagcgggccgccgcgggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatcagcaccctctgggagggcaacccggggcggttctggaacaccaccatcgccgtctccatggcgaacatcttccgcggcagctacctggccggcgccgggctcctcttctccatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtggaccggaccctggccaaggaggggatcaagcgcggcgagaccgaccaccacgcggtgtcccgggggagcgccaagctgcgctggttcgtcgagcggaacatggtgacccccgagggcaaggtggtcgacctcggctgcgggcgcggcgggtggtcctactactgcggcgggctgaagaacgtgcgggaggtgaagggcctgacgaagggcgggcccggccacgaggagcccatcccgatgagcacctacgggtggaacctcgtccgcctgcagtccggcgtggacgtgttcttcatcccgcccgagaagtgcgacaccctgctctgcgacatcggggagagctcccccaacccgaccgtcgaggccggccggacgctgcgcgtgctgaacctcgtggagaactggctgaacaacaacacccagttctgcatcaaggtcctgaacccctacatgcccagcgtgatcgagaagatggaggccctgcagcggaagtacggcggggcgctcgtgcgcaacccgctgtcccggaacagcacccacgagatgtactgggtcagcaacgcctccggcaacatcgtgagctccgtgaacatgatcagccgcatgctgatcaaccggttcaccatgcgccacaagaaggccacctacgagcccgacgtcgacctcgggtccggcacgcggaacatcgggatcgagagcgagacccccaacctggacatcatcggcaagcgcatcgagaagatcaaggaggagcacgagacctcctggcactacgaccaggaccacccctacaagacctgggcctaccacggcagctacgagacgaagcagaccgggtccgccagctccatggtgaacggcgtggtccggctgctcaccaagccgtgggacgtgctgcccaccgtgacgcagatggcgatgaccgacaccacccccttcgggcagcagcgcgtcttcaaggagaaggtggacacgcgcacccaggagcccaaggagggcaccaagaagctgatgaagatcaccgccgagtggctctggaaggagctgggcaagaagaagacgccgcggatgtgcacccgcgaggagttcacccggaaggtgcgcagcaacgccgccctgggggccatcttcaccgacgagaacaagtggaagtccgcgcgggaggccgtcgaggacagccgcttctgggagctcgtggacaaggagcggaacctgcacctggagggcaagtgcgagacgtgcgtctacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaactccctgagcggcgtggagggggagggcctccacaagctggggtacatcctgcgcgacgtgtccaagaaggagggcggcgccatgtacgccgacgacaccgccgggtgggacacccggatcaccctcgaggacctgaagaacgaggagatggtcacgaaccacatggagggcgagcacaagaagctggcggaggccatcttcaagctcacctaccagaacaaggtggtgcgcgtccagcggcccacgccccgggggaccgtgatggacatcatcagccggcgcgaccagcggggcagcggccaggtggggacgtacggcctgaacaccttcaccaacatggaggcccagctgatccgccagatggagggggagggcgtcttcaagaacatccagcacctcaccgtgacggaggaggccgccgtgcagaactggctggcgcgggtcgggcgcgagcgcctgtcccggatggccatcagcggcgacgactgcgtggtgaagcccctcgacgaccgcttcgccaacgccctgaccgccctgaacgacatgggcaagatccggaaggacatccagcagtgggagccgtccaaggggtggaacgactggacccaggtccccttctgcagccaccacttccacgagctcatcatgaaggacggccgcgtgctggtggtcccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtgcccagccactgggtgccgacgtcccgcaccacctggagcatccacgccaagcacgagtggatgaccaccgaggacatgctgacggtctggaaccgggtgtggatccgcgagaacccctggatggaggacaagacccccgtggagtcctgggaggagatcccctacctcggcaagcgggaggaccagtggtgcgggagcctgatcggcctgacctcccgcgccacctgggcgaagaacatccaggccgccatcaaccaggtccggagcctcatcgggaacgaggagtacacggactacatgccgtccatgaagcgcttccggcgcgaggaggaggaggccggcgtgctgtggtga

SEQ ID NO: 9179 - RNA, 9876 nt, synthetic construct
  misc_feature 1..9876: note = derived and/or modified CDS sequence (opt1) from DENV-2__JF730047__SS-prME
  source 1..9876: mol_type = other RNA
agcgccggcatgatcatcatgctgatccccaccgtgatggccttccacctcaccacccgcaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagtccaaggcctggctcgtgcaccgccagtggttcctggacctgcccctcccctggctgccgggggccgacaagcagggcagcaactggatccagaaggagaccctggtgaccttcaagaacccccacgcgaagaagcaggacgtcgtggtcctcgggagccaggagggcgccatgcacacggccctgaccggggccaccgagatccagatgtccagcggcaacctcctgttcaccggccacctgaagtgccggctgcgcatggacaagctccagctgaaggggatgtcctacagcatgtgcacgggcaagttcaaggtggtgaaggagatcgccgagacccagcacgggaccatcgtcatccgggtgcagtacgagggcgacggctccccctgcaagatccccttcgagatcatggacctggagaagcgctacgtgctcgggcggctgatcaccgtcaacccgatcgtgacggagaaggacagccccgtgaacatcgaggcggagccgcccttcggcgactcctacatcatcatcggggtcgagccgggccagctgaagctcaactggttcaagaaggggagctccatcggccagatgttcgagaccaccatgcgcggcgccaagcgcatggccatcctgggggacaccgcctgggacttcggcagcctcggcggggtgttcacgtccatcgggaaggccctccaccaggtgttcggggcgatctacggcgccgccttcagcggggtctcctggaccatgaagatcctgatcggcgtgatcatcacctggatcgggatgaacagccggtccaccagcctgtccgtgagcctggtcctcgtgggcatcgtgacgctgtacctgggggtcatggtgcaggccgactccggctgcgtggtcagctggaagaacaaggagctcaagtgcggcagcgggatcttcatcaccgacaacgtgcacacctggaccgagcagtacaagttccagcccgagtcccccagcaagctggcgtccgccatccagaaggcccaggaggagggcatctgcgggatccgcagcgtgacgcggctggagaacctcatgtggaagcagatcacccccgagctgaaccacatcctggccgagaacgaggtcaagctcaccatcatgaccggcgacatcaaggggatcatgcaggccggcaagcgctccctgcggccgcagcccacggagctgaagtacagctggaagacctggggcaaggcgaagatgctctccaccgagagccacaaccagaccttcctgatcgacgggcccgagacggccgagtgcccgaacaccaaccgcgcctggaactccctggaggtggaggactacggcttcggggtgttcaccaccaacatctggctcaagctgaaggagaagcaggacgccttctgcgacagcaagctgatgtccgccgcgatcaaggacaaccgggccgtccacgccgacatgggctactggatcgagagcgccctcaacgacacgtggaagatcgagaaggcctccttcatcgaggtgaagaactgccactggcccaagagccacaccctgtggtccaacggcgtgctggagagcgagatgatcatccccaagaacctcgcggggcccgtctcccagcacaactaccgcccgggctaccacacccagaccgccgggccctggcacctgggcaagctggagatggacttcgacttctgcgacgggaccacggtgatcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccaggtggacaacttctccctgggcgtcctggggatggccctgttcctggaggagatgctgcggacgcgcgtgggcaccaagcacgccatcctcctggtggccgtcagcttcgtgaccctgatcaccgggaacatgtccttcaaggacctcggccgggtggtcgtgatggtggggacgaccatgaccgacgacatcggcatgggcgtcacctacctggccctgctcgccgcgttcaaggtgcgccccacgttcgccgccgggctgctgctccggaagctgaccagcaaggagctgatgatgaccaccatcggcatcgtgctcctgtcccagagcacgatccccgagaccatcctggagctcaccgacgccctggccctggggatgatggtcctcaagatcgtgcgcgacatggagaagtaccagctggcggtgaccatcatggccatcctgtgcgtcccgaacgccgtgatcctccagaacgcctggaaggtctcctgcacgatcctggccgtggtgagcgtcagccccctgctcctgaccagctcccagcagaagaccgactggatccccctggcgctcaccatcaagggcctgaaccccacggccatcttcctgaccaccctcagccgcaccaacaagaagcggtcctggccgctgaacgaggccatcatggccgtgggcatggtgagcatcctggcgtccagcctcctgaagaacgacatccccatgacggggcccctggtcgccggcgggctcctgaccgtgtgctacgtgctgaccggccgctccgccgacctcgagctggagcgggccaccgacgtcaagtgggaggaccaggccgagatcagcgggagctcccccatcctgagcatcacgatctccgaggacggcagcatgtccatcaagaacgaggaggaggagcagaccctcaccatcctgatccgcaccggcctgctcgtgatcagcgggctgttcccggtgtccatccccatcaccgcggccgcctggtacctgtgggaggtcaagaagcagcgggccggcgtgctctgggacgtgccctccccgccgcccatggggaaggccgagctggaggacggcgcgtaccgcatcaagcagaaggggatcctgggctactcccagatcggcgccggggtctacaaggagggcacgttccacaccatgtggcacgtgacccgcggggcggtgctcatgcacaagggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagaccaagcccggcctgttcaagacgaacaccgggaccatcggcgccgtgagcctcgacttctcccccggcaccagcgggtcccccatcatcgacaagaagggcaaggtggtcgggctgtacggcaacggcgtggtgacgcgcagcggggcctacgtctccgccatcgcccagaccgagaagtccatcgaggacaaccccgagatcgaggacgacatcttccggaagcgccggctgaccatcatggacctgcaccccggcgcggggaagaccaagcgctacctccccgccatcgtgcgggaggccatcaagcgcggcctgcggacgctgatcctcgccccgacccgcgtggtcgcggccgagatggaggaggccctgcgggggctgcccatccgctaccagacccccgccatccgggccgagcacaccggccgcgagatcgtggacctcatgtgccacgcgacgttcaccatgcgcctgctgtcccccgtgcgggtcccgaactacaacctcatcatcatggacgaggcccacttcaccgaccccgccagcatcgccgcccgcggctacatcagcacccgggtggagatgggggaggcggccggcatcttcatgacggccacgccgcccgggtcccgcgacccgttcccccagagcaacgcccccatcatcgacgaggagcgggagatccccgagcgctcctggaacaccggccacgagtgggtgaccgacttcaaggggaagacggtctggttcgtgccgagcatcaaggccggcaacgacatcgcggcctgcctgcggaagaacggcaagaaggtgatccagctgtcccgcaagaccttcgacagcgagtacgtcaagacccggaccaacgactgggacttcgtggtgacgaccgacatctccgagatgggggccaacttcaaggccgagcgcgtcatcgacccccggcgctgcatgaagcccgtgatcctcaccgacggcgaggagcgggtgatcctggcggggcccatgccggtcacccacagctccgccgcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgcgagaaggtggacgcgatcgacggggagtaccggctgcgcggcgaggcccgcaagaccttcgtggacctcatgcggcgcggggacctgcccgtctggctggcctacaaggtggccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctactccgaccccctcgccctgaaggagttcaaggagttcgccgccggccgcaagagcctgaccctcaacctgatcacggagatggggcggctgcccaccttcatgacccagaagacccgcgacgcgctcgacaacctggccgtgctgcacacggccgaggccggcgggcgggcgtacaaccacgccctctccgagctgcccgagaccctggagaccctcctgctgctcaccctgctggccaccgtcacgggcggcatcttcctcttcctgatgagcgggcgcggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacgtacgtggtcatcgccatcctgaccgtggtggccgccaccatggcgaacgagatggggttcctggagaagaccaagaaggacctcggcctgggctccatcgccacgcagcagccggagagcaacatcctggacatcgacctccgccccgcctccgcctggaccctgtacgccgtcgcgaccaccttcgtgacgcccatgctgcggcacagcatcgagaacagctccgtgaacgtcagcctcaccgccatcgccaaccaggccaccgtgctgatggggctgggcaaggggtggcccctctccaagatggacatcggcgtgccgctgctggccatcgggtgctacagccaggtcaaccccatcaccctcacggcggccctgctgctcctggtggcccactacgccatcatcggccccggcctgcaggcgaaggccacccgcgaggcccagaagcgggccgccgcggggatcatgaagaaccccaccgtggacggcatcaccgtcatcgacctcgacccgatcccctacgaccccaagttcgagaagcagctgggccaggtgatgctgctcatcctgtgcgtgacgcaggtcctgatgatgcgcaccacctgggccctctgcgaggccctgaccctggccacgggccccatctccaccctctgggaggggaacccgggccggttctggaacaccaccatcgccgtgagcatggcgaacatcttccgcggctcctacctggccggggccggcctcctcttcagcatcatgaagaacacgaccaacacccggcgcgggaccggcaacatcggcgagacgctgggggagaagtggaagtcccgcctgaacgccctcggcaagagcgagttccagacctacaagaagtccgggatccaggaggtggaccggaccctggccaaggagggcatcaagcgcggggagaccgaccaccacgcggtcagccggggctccgccaagctgcgctggttcgtggagcggaacatggtgacgcccgagggcaaggtcgtggacctcgggtgcggccgcgggggctggagctactactgcgggggcctgaagaacgtgcgggaggtcaagggcctgaccaagggcgggcccgggcacgaggagcccatcccgatgtccacctacggctggaacctcgtgcgcctgcagagcggggtggacgtcttcttcatcccgcccgagaagtgcgacaccctgctctgcgacatcggcgagtccagccccaacccgaccgtggaggccggccggacgctgcgcgtgctgaacctcgtcgagaactggctgaacaacaacacccagttctgcatcaaggtgctgaacccctacatgccctccgtgatcgagaagatggaggccctgcagcggaagtacgggggcgcgctcgtccgcaacccgctgagccggaacagcacccacgagatgtactgggtgtccaacgccagcgggaacatcgtgtccagcgtcaacatgatctcccgcatgctgatcaaccggttcaccatgcgccacaagaaggccacgtacgagcccgacgtggacctcggcagcgggacccggaacatcggcatcgagtccgagatccccaacctggacatcatcggcaagcgcatcgagaagatcaagcaggagcacgagaccagctggcactacgaccaggaccacccctacaagacctgggcctaccacgggtcctacgagacgaagcagaccggcagcgcctccagcatggtgaacggggtcgtgcggctgctcaccaagccgtgggacgtgctgcccaccgtcacgcagatggcgatgaccgacaccacccccttcggccagcagcgcgtgttcaaggagaaggtggacacgcgcacccaggagcccaaggagggcaccaagaagctgatgaagatcaccgccgagtggctctggaaggagctggggaagaagaagacgccgcggatgtgcacccgcgaggagttcatccggaaggtccgctccaacgccgccctgggcgccatcttcaccgacgagaacaagtggaagtccgcgcgggaggccgtggaggactcccgcttctgggagctcgtggacaaggagcggaacctgcacctggaggggaagtgcgagacctgcgtctacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggagaacagcctgtccggggtggagggcgaggggctccacaagctgggctacatcctgcgcgacgtcagcaagaaggagggcggggccatgtacgccgacgacacggccggctgggacacccggatcaccctcgaggacctgaagaacgaggagatggtgaccaaccacatggagggggagcacaagaagctggcggaggccatcttcaagctcacgtaccagaacaaggtggtccgcgtgcagcggcccacgccccggggcaccgtgatggacatcatcagccggcgcgaccagcgggggtccggccaggtcggcacctacgggctgaacacgttcaccaacatggaggcccagctgatccgccagatggagggcgagggggtgttcaagaacatccagcacctcaccgccaccgaggaggtggccgtcaagaactggctggcgcgggtgggccgcgagcgcctgagccggatggccatctccggcgacgactgcgtggtcaagcccctcgacgaccgcttcgccaacgccctgacggccctgaacgacatggggaagatccggaaggacatccagcagtgggagccgagcaagggctggaacgactggacccaggtgcccttctgctcccaccacttccacgagctcatcatgaaggacgggcgcgtgctggtcgtgccctgccggaaccaggacgagctgatcggccgcgcgcggatcagccagggggccggctggtccctccgcgagaccgcctgcctgggcaagagctacgcccagatgtggtccctgatgtacttccaccggcgcgacctccggctggccgcgaacgccatctgcagcgccgtgccctcccactgggtcccgaccagccgcaccacgtggtccatccacgccaagcacgagtggatgaccaccgaggacatgctgaccgtgtggaaccgggtgtggatccgcgagaacccctggatggaggacaagacgcccgtcgagagctgggaggagatcccctacctcgggaagcgggaggaccagtggtgcggctccctgatcgggctgaccagccgcgccacctgggcgaagaacatccaggccgccatcaaccaggtgcggtccctcatcggcaacgaggagtacaccgactacatgccgagcatgaagcgcttccggcgcgaggaggaggaggccggggtgctgtggtga

SEQ ID NO: 9180 - RNA, 9876 nt, synthetic construct
  misc_feature 1..9876: note = derived and/or modified CDS sequence (opt1) from DENV-2__JF730048__SS-prME
  source 1..9876: mol_type = other RNA
agcgccggcatgatcatcatgctgatccccaccgtgatggccttccacctcaccacccgcaacggggagccccacatgatcgtgggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgagcagcgagggggcctggaagcacgcccagcgcatcgagacctggatcctgcggcacccgggcttcaccatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgcccgacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagtccaaggcctggctcgtgcaccgccagtggttcctggacctgcccctcccctggctgccgggggccgacaagcagggcagcaactggatccagaaggagaccctggtgaccttcaagaacccccacgcgaagaagcaggacgtcgtggtcctcgggagccaggagggcgccatgcacacggccctgaccggggccaccgagatccagatgtccagcggcaacctcctgttcaccggccacctgaagtgccggctgcgcatggacaagctccagctgaaggggatgtcctacagcatgtgcacgggcaagttcaaggtggtgaaggagatcgccgagacccagcacgggaccatcgtcatccgggtgcagtacgagggcgacggctccccctgcaagatccccttcgagatcatggacctggagaagcgctacgtgctcgggcggctgatcaccgtcaacccgatcgtgacggagaaggacagccccgtgaacatcgaggcggagccgcccttcggcgactcctacatcatcatcggggtcgagccgggccagctgaagctcaactggttcaagaaggggagctccatcggccagatgttcgagaccaccatgcgcggcgccaagcgcatggccatcctgggggacaccgcctgggacttcggcagcctcggcggggtgttcacgtccatcgggaaggccctccaccaggtgttcggggcgatctacggcgccgccttcagcggggtctcctggaccatgaagatcctgatcggcgtgatcatcacctggatcgggatgaacagccggtccaccagcctgtccgtgagcctggtcctcgtgggcatcgtgacgctgtacctgggggtcatggtgcaggccgactccggctgcgtggtcagctggaagaacaaggagctcaagtgcggcagcgggatcttcatcaccgacaacgtgcacacctggaccgagcagtacaagttccagcccgagtcccccagcaagctggcgtccgccatccagaaggcccaggaggagggcatctgcgggatccgcagcgtgacgcggctggagaacctcatgtggaagcagatcacccccgagctgaaccacatcctggccgagaacgaggtcaagctcaccatcatgaccggcgacatcaaggggatcatgcaggccggcaagcgctccctgcggccgcagcccacggagctgaagtacagctggaagacctggggcaaggcgaagatgctctccaccgagagccacaaccagaccttcctgatcgacgggcccgagacggccgagtgcccgaacaccaaccgcgcctggaactccctggaggtggaggactacggcttcggggtgttcaccaccaacatctggctcaagctgaaggagaagcaggacgccttctgcgacagcaagctgatgtccgccgcgatcaaggacaaccgggccgtccacgccgacatgggctactggatcgagagcgccctcaacgacacgtggaagatcgagaaggcctccttcatcgaggtgaagaactgccactggcccaagagccacaccctgtggtccaacggcgtgctggagagcgagatgatcatccccaagaacctcgcggggcccgtctcccagcacaactaccgcccgggctaccacacccagaccgccgggccctggcacctgggcaagctggagatggacttcgacttctgcgacgggaccacggtgatcgtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccaggtggacaacttctccctgggcgtcctggggatggccctgttcctggaggagatgctgcggacgcgcgtgggcaccaagcacgccatcctcctggtggccgtcagcttcgtgaccctgatcaccgggaacatgtccttcaaggacctcggccgggtggtcgtgatggtggggacgaccatgaccgacgacatcggcatgggcgtcacctacctggccctgctcgccgcgttcaaggtgcgccccacgttcgccgccgggctgctgctccggaagctgaccagcaaggagctgatgatgaccaccatcggcatcgtgctcctgtcccagagcacgatccccgagaccatcctggagctcaccgacgccctggccctggggatgatggtcctcaagatcgtgcgcgacatggagaagtaccagctggcggtgaccatcatggccatcctgtgcgtcccgaacgccgtgatcctccagaacgcctggaaggtctcctgcacgatcctggccgtggtgagcgtcagccccctgctcctgaccagctcccagcagaagaccgactggatccccctggcgctcaccatcaagggcctgaaccccacggccatcttcctgaccaccctcagccgcaccaacaagaagcggtcctggccgctgaacgaggccatcatggccgtgggcatggtgagcatcctggcgtccagcctcctgaagaacgacatccccatgacggggcccctggtcgccggcgggctcctgaccgtgtgctacgtgctgaccggccgctccgccgacctcgagctggagcgggccaccgacgtcaagtgggaggaccaggccgagatcagcgggagctcccccatcctgagcatcacgatctccgaggacggcagcatgtccatcaagaacgaggaggaggagcagaccctcaccatcctgatccgcaccggcctgctcgtgatcagcgggctgttcccggtgtccatccccatcaccgcggccgcctggtacctgtgggaggtcaagaagcagcgggccggcgtgctctgggacgtgccctccccgccgcccatggggaaggccgagctggaggacggcgcgtaccgcatcaagcagaaggggatcctgggctactcccagatcggcgccggggtctacaaggagggcacgttccacaccatgtggcacgtgacccgcggggcggtgctcatgcacaagggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagaccaagcccggcctgttcaagacgaacaccgggaccatcggcgccgtgagcctcgacttctcccccggcaccagcgggtcccccatcatcgacaagaagggcaaggtggtcgggctgtacggcaacggcgtggtgacgcgcagcggggcctacgtctccgccatcgcccagaccgagaagtccatcgaggacaaccccgagatcgaggacgacatcttccggaagcgccggctgaccatcatggacctgcaccccggcgcggggaagaccaagcgctacctccccgccatcgtgcgggaggccatcaagcgcggcctgcggacgctgatcctcgccccgacccgcgtggtcgcggccgagatggaggaggccctgcgggggctgcccatccgctaccagacccccgccatccgggccgagcacaccggccgcgagatcgtggacctcatgtgccacgcgacgttcaccatgcgcctgctgtcccccgtgcgggtcccgaactacaacctcatcatcatggacgaggcccacttcaccgaccccgccagcatcgccgcccgcggctacatcagcacccgggtggagatgggggaggcggccggcatcttcatgacggccacgccgcccgggtcccgcgacagcttcccgcagtccaacgcccccatcatcgacgaggagcgggagatccccgagcgcagctggaacaccggccacgagtgggtgaccgacttcaaggggaagacggtctggttcgtgccctccatcaaggccggcaacgacatcgcggcctgcctgcggaagaacggcaagaaggtgatccagctgagccgcaagaccttcgactccgagtacgtcaagacccggaccaacgactgggacttcgtggtgacgaccgacatcagcgagatgggggccaacttcaaggccgagcgcgtcatcgacccgcggcgctgcatgaagcccgtgatcctcaccgacggcgaggagcgggtgatcctggcggggcccatgcccgtcacccactccagcgccgcccagcgccggggccgcatcgggcggaacccgaagaacgagaacgaccagtacatctacatgggcgagcccctggagaacgacgaggactgcgcccactggaaggaggccaagatgctcctggacaacatcaacacgcccgagggcatcatcccctccatgttcgagccggagcgcgagaaggtggacgcgatcgacggggagtaccggctgcgcggcgaggcccgcaagaccttcgtggacctcatgcggcgcggggacctgcccgtctggctggcctacaaggtggccgccgagggcatcaactacgcggaccggcgctggtgcttcgacgggatcaagaacaaccagatcctcgaggagaacgtggaggtcgagatctggaccaaggagggcgagcggaagaagctgaagccccgctggctggacgcccggatctacagcgacccgctcgccctgaaggagttcaaggagttcgccgccggccgcaagtccctgaccctcaacctgatcacggagatggggcggctgcccaccttcatgacccagaagacccgcgacgcgctcgacaacctggccgtgctgcacacggccgaggccggcgggcgggcgtacaaccacgccctcagcgagctgcccgagaccctggagaccctcctgctgctcaccctgctggccaccgtcacgggcggcatcttcctcttcctgatgtccgggcgcggcatcgggaagatgaccctgggcatgtgctgcatcatcaccgccagcatcctcctgtggtacgcccagatccagccccactggatcgcggcctccatcatcctggagttcttcctcatcgtgctgctgatcccggagcccgagaagcagcggacgccccaggacaaccagctcacgtacgtggtcatcgccatcctgaccgtggtggccgccaccatggcgaacgagatggggttcctggagaagaccaagaaggacctcggcctgggcagcatcgccacgcagcagcccgagtccaacatcctggacatcgacctccgcccggccagcgcctggaccctgtacgccgtcgcgaccaccttcgtgacgcccatgctgcggcacagcatcgagaactccagcgtgaacgtctccctcaccgccatcgccaaccaggccaccgtgctgatggggctgggcaaggggtggcccctcagcaagatggacatcggcgtgcccctgctggccatcgggtgctactcccaggtcaacccgatcaccctcacggcggccctgctgctcctggtggcccactacgccatcatcggccccggcctgcaggcgaaggccacccgcgaggcccagaagcgggccgccgcggggatcatgaagaaccccaccgtggacggcatcaccgtcatcgacctcgaccccatcccgtacgaccccaagttcgagaagcagctgggccaggtgatgctgctcatcctgtgcgtgacgcaggtcctgatgatgcgcaccacctgggccctctgcgaggccctgaccctggccacgggccccatcagcaccctctgggaggggaaccccggccggttctggaacaccaccatcgccgtgtccatggcgaacatcttccgcggcagctacctggccggggccggcctcctcttctccatcatgaagaacacgaccaacacccggcgcgggaccggcaacatcggcgagacgctgggggagaagtggaagtcccgcctgaacgccctcggcaagtccgagttccagacctacaagaagtccgggatccaggaggtggaccggaccctggccaaggagggcatcaagcgcggggagaccgaccaccacgcggtctcccggggcagcgccaagctgcgctggttcgtggagcggaacatggtgacgccggagggcaaggtcgtggacctcgggtgcggccgcgggggctggtcctactactgcgggggcctgaagaacgtgcgggaggtcaagggcctgaccaagggcgggcccgggcacgaggagcccatccccatgagcacctacggctggaacctcgtgcgcctgcagtccggggtggacgtcttcttcatcccgcccgagaagtgcgacaccctgctctgcgacatcggcgagagctcccccaaccccaccgtggaggccggccggacgctgcgcgtgctgaacctcgtcgagaactggctgaacaacaacacccagttctgcatcaaggtgctgaacccgtacatgcccagcgtgatcgagaagatggaggccctgcagcggaagtacgggggcgcgctcgtccgcaaccccctgagccggaactccacccacgagatgtactgggtgagcaacgcctccgggaacatcgtgagctccgtcaacatgatcagccgcatgctgatcaaccggttcaccatgcgccacaagaaggccacgtacgagccggacgtggacctcggctccgggacccggaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtcgtgcggctgctcaccaagccctgggacgtgctgccgaccgtcacgcagatggcgatgaccgacaccacccccttcggccagcagcgcgtgttcaaggagaaggtggacacgcgcacccaggagcccaaggagggcaccaagaagctgatgaagatcaccgccgagtggctctggaaggagctggggaagaagaagacgccccggatgtgcacccgcgaggagttcacccggaaggtccgcagcaacgccgccctgggcgccatcttcaccgacgagaacaagtggaagtccgcgcgggaggccgtggaggacagccgcttctgggagctcgtggacaaggagcggaacctgcacctggaggggaagtgcgagacgtgcgtctacaacatgatgggcaagcgcgagaagaagctcggggagttcggcaaggccaagggctcccgggccatctggtacatgtggctgggggcccgcttcctggagttcgaggcgctcggcttcctgaacgaggaccactggttcagccgggagaactccctgagcggggtggagggcgaggggctccacaagctgggctacatcctgcgcgacgtcagcaagaaggagggcggggccatgtacgccgacgacaccgccggctgggacacccggatcaccctcgaggacctgaagaacgaggagatggtgacgaaccacatggagggggagcacaagaagctggcggaggccatcttcaagctcacctaccagaacaaggtggtccgcgtgcagcggccgacgccccggggcaccgtgatggacatcatctcccggcgcgaccagcgggggagcggccaggtcggcacgtacgggctgaacaccttcaccaacatggaggcccagctgatccgccagatggagggcgagggggtgttcaagaacatccagcacctcaccgccacggaggaggtggccgtcaagaactggctggcgcgggtgggccgcgagcgcctgtcccggatggccatcagcggcgacgactgcgtggtcaagcccctcgacgaccgcttcgccaacgccctgaccgccctgaacgacatggggaagatccggaaggacatccagcagtgggagccctccaagggctggaacgactggacccaggtgccgttctgcagccaccacttccacgagctcatcatgaaggacgggcgcgtgctggtcgtgccctgccggaaccaggacgagctgatcggccgcgcgcggatctcccagggggccggctggagcctccgcgagaccgcctgcctgggcaagtcctacgcccagatgtggagcctgatgtacttccaccggcgcgacctccggctggccgcgaacgccatctgctccgccgtgcccagccactgggtccccacctcccgcacgacctggagcatccacgccaagcacgagtggatgaccaccgaggacatgctgacggtgtggaaccgggtgtggatccgcgagaacccgtggatggaggacaagacccccgtcgagtcctgggaggagatcccctacctcgggaagcgggaggaccagtggtgcggcagcctgatcgggctgacctcccgcgccacctgggcgaagaacatccaggccgccatcaaccaggtgcggagcctcatcggcaacgaggagtacacggactacatgcccagcatgaagcgcttccggcgcgaggaggaggaggccggggtgctgtggtga

SEQ ID NO: 9181 - RNA, 9876 nt, synthetic construct
  misc_feature 1..9876: note = derived and/or modified CDS sequence (opt1) from DENV-2__KF955402__SS-prME
  source 1..9876: mol_type = other RNA
agcgccgggatgatcatcatgctgatccccaccgtgatggccttccacctcaccacccgcaacggggagccccacatgatcgtggggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgtcctcatcttcatcctgctgacggccgtggccccctccatgaccatgcggtgcatcggcatcagcaaccgcgtgttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtcgaccgcggctgggggaacggctgcggcctgttcggcaagggcgggatcgtgacgtgcgccatgttcacgtgcaagaagaacatggagggcaagatcgtgcagcccgagaacctggagtacaccatcgtcgtgacgccccactccggggaggagcacgcggtgggcaacgacacggggaagcacggcatggagatcaaggtcaccccgcagagctccatcaccgaggccgagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtcgtgaaggagatcgccgagacccagcacggcaccatcgtgatccgggtccagtacgagggggacggcagcccctgcaagatccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtcttcacgagcatcggcaaggccctccaccaggtgttcggggccatctacggcgtggcgttctccggcgtcagctggaccatgaagatcctgatcggggtgatcatcacctggatcggcatgaactcccggagcacctccctgagcgtgtccctggtcctcgtggggatcgtgacgctgtacctgggcgtcatggtgcaggccgacagcgggtgcgtggtctcctggaagaacaaggagctcaagtgcggcagcggcatcttcatcaccgacaacgtgcacacctggaccgagcagtacaagttccagcccgagagcccctccaagctggccagcgccatccagaaggcgcaggaggaggggatctgcggcatccgctccgtgacgcggctggagaacctcatgtggaagcagatcacccccgagctgaaccacatcctggccgagaacgaggtcaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggccgagtgcccgaacaccaaccgcgcgtggaacagcctggaggtggaggactacgggttcggcgtgttcaccaccaacatctggctcaagctgaaggagaagcaggacgccttctgcgactccaagctgatgagcgccgccatcaaggacaaccgggccgtccacgcggacatggggtactggatcgagtccgccctcaacgacacgtggaagatcgagaaggccagcttcatcgaggtgaagaactgccactggcccaagtcccacaccctgtggagcaacggcgtgctggagtccgagatgatcatccccaagaacctcgccggccccgtcagccagcacaactaccgcccggggtaccacacccagatcgccggcccctggcacctggggaagctggagatggacttcgacttctgcgacggcaccaccgtgatcgtgacggaggactgcgggaaccggggcccctccctccgcaccaccaccgcgagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacggccaggtggacaacttcagcctgggcgtcctgggcatggccctcttcctggaggagatgctgcggacccgcgtggggacgaagcacgccatcctcctggtggcggtctccttcgtgaccctgatcaccggcaacatgagcttcaaggacctcgggcgggtggtcgtgatggtgggcgccaccatggccgacgacatcgggatgggcgtcacgtacctggccctgctcgccgcgttcaaggtgcgccccaccttcgccgccggcctgctgctccggaagctgacctccaaggagctgatgatgaccacgatcgggatcgtgctcctgagccagtccaccatccccgagaccgtcctggagctcaccgacgccctggccctgggcatgatggtgctcaagatcgtccgcaacatggagaagtaccagctggcggtgacgatcatggccatcctgtgcgtgccgaacgccgtcatcctccagaacgcctggaaggtgagctgcaccatcctggccgtggtctccgtgagccccctgctcctgacctccagccagcagaagaccgactggatccccctggcgctcacgatcaaggggctgaaccccaccgccatcttcctgaccaccctctcccgcacgaacaagaagcggagctggccgctgaacgaggccatcatggccgtgggcatggtctccatcctggcgagctccctcctgaagaacgacatccccatgaccggccccctggtggccgggggcctcctgaccgtgtgctacgtcctgaccgggcgcagcgccgacctcgagctggagcgggccacggacgtgaagtgggaggaccaggccgagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgcggccgcctggtacctgtgggaggtcaagaagcagcgggccggggtgctctgggacgtgcccagcccgccgcccatgggcaaggccgagctggaggacggggcgtaccgcatcaagcagaagggcatcctggggtacagccagatcggcgccggcgtctacaaggaggggaccttccacaccatgtggcacgtgacccggggcgccgtgctcatgcacaaggggaagcgcatcgagccctcctgggccgacgtcaagaaggacctgatcagctacggcgggggctggaagctggagggcgagtggaaggagggggaggaggtccaggtgctcgccctggagcccggcaagaacccccgggcggtccagacgaagcccgggctgttcaagaccaacaccggcaccatcggggccgtgtccctcgacttcagccccggcacgtccggcagccccatcatcgacaagaaggggaaggtggtcggcctgtacgggaacggcgtggtgacccgctccggcgcctacgtcagcgccatcgcccagaccgagaagtccatcgaggacaaccccgagatcgaggacgacatcttccggaagcgccggctgaccatcatggacctgcaccccggggcgggcaagacgaagcgctacctccccgccatcgtgcgggaggccatcaagcgcgggctgcggaccctgatcctcgccccgacccgcgtggtcgcggccgagatggaggaggccctgcggggcctgcccatccgctaccagacccccgccatccgggccgagcacacggggcgcgagatcgtggacctcatgtgccacgcgaccttcaccatgcgcctgctgagccccgtgcgggtcccgaactacaacctcatcatcatggacgaggcccacttcaccgaccccgcctccatcgccgcccgcggctacatcagcacgcgggtggagatgggcgaggcggccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtctggttcgtgccgagcatcaaggccgggaacgacatcgcggcctgcctgcggaagaacggcaagaaggtgatccagctgtcccgcaagaccttcgacagcgagtacgtcaagacccggaccaacgactgggacttcgtggtgacgaccgacatctccgagatgggcgccaacttcaaggccgagcgcgtcatcgacccccggcgctgcatgaagcccgtgatcctcaccgacggggaggagcgggtgatcctggcgggccccatgccggtcacccacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacgcccgagggcatcatcccgagcatgttcgagcccgagcgcgagaaggtggacgcgatcgacggcgagtaccggctgcgcggggaggcccgcaagaccttcgtggacctcatgcggcgcggcgacctgcccgtctggctggcctacaaggtggccgccgaggggatcaactacgcggaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgccggccgcaagagcctgaccctcaacctgatcacggagatgggccggctgcccaccttcatgacccagaagacccgcgacgcgctcgacaacctggccgtgctgcacacggccgaggccgggggccgggcgtacaaccacgccctctccgagctgcccgagaccctggagaccctcctgctgctcaccctgctggccacggtcaccgggggcatcttcctcttcctgatgagcggccgcgggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacgtacgtggtcatcgccatcctgaccgtggtggccgccaccatggcgaacgagatgggcttcctggagaagaccaagaaggacctcgggctgggctccatcgccacgcagcagccggagagcaacatcctggacatcgacctccgccccgcctccgcctggaccctgtacgccgtcgcgaccaccttcgtgacgcccatgctgcggcacagcatcgagaacagctccgtgaacgtcagcctcaccgccatcgccaaccaggccaccgtgctgatgggcctggggaagggctggcccctctccaagatggacatcggggtgccgctgctggccatcggctgctacagccaggtcaaccccatcaccctcacggcggccctgctgctcctggtggcccactacgccatcatcgggcccggcctgcaggcgaaggccacccgcgaggcccagaagcgggccgccgcgggcatcatgaagaaccccaccgtggacgggatcaccgtcatcgacctcgacccgatcccctacgaccccaagttcgagaagcagctgggccaggtgatgctgctcatcctgtgcgtgacgcaggtcctgatgatgcgcaccacctgggccctctgcgaggccctgaccctggccacggggcccatctccaccctctgggagggcaacccggggcggttctggaacaccaccatcgccgtgagcatggcgaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtggaccggaccctggccaaggaggggatcaagcgcggcgagaccgaccaccacgcggtcagccgggggtccgccaagctgcgctggttcgtggagcggaacatggtgacccccgagggcaaggtcgtggacctcggctgcgggcgcggcgggtggagctactactgcggcgggctgaagaacgtgcgggaggtcaagggcctgacgaagggcgggcccggccacgaggagcccatcccgatgtccacctacgggtggaacctcgtgcgcctgcagagcggcgtggacgtcttcttcatcccgcccgagaagtgcgacaccctgctctgcgacatcggggagtccagccccaacccgaccgtggaggccggccggacgctgcgcgtgctgaacctcgtcgagaactggctgaacaacaacacccagttctgcatcaaggtgctgaacccctacatgccctccgtgatcgagaagatggaggccctgcagcggaagtacggcggggcgctcgtccgcaacccgctgagccggaacagcacccacgagatgtactgggtgtccaacgccagcggcaacatcgtgtccagcgtcaacatgatctcccgcatgctgatcaaccggttcaccatgcgccacaagaaggccacctacgagcccgacgtggacctcgggagcggcacgcggaacatcgggatcgagtccgagacccccaacctggacatcatcggcaagcgcatcgagaagatcaaggaggagcacgagaccagctggcactacgaccaggaccacccctacaagacctgggcctaccacggctcctacgagacgaagcagaccgggagcgcctccagcatggtgaacggcgtcgtgcggctgctcaccaagccgtgggacgtgctgcccaccgtcacgcagatggcgatgaccgacaccacccccttcgggcagcagcgcgtgttcaaggagaaggtggacacgcgcacccaggagcccaaggagggcaccaagaagctgatgaagatcaccgccgagtggctctggaaggagctgggcaagaagaagacgccgcggatgtgcacccgcgaggagttcacccggaaggtccgctccaacgccgccctgggggccatcttcaccgacgagaacaagtggaagtccgcgcgggaggccgtggaggactcccgcttctgggagctcgtcgacaaggagcggaacctgcacctggagggcaagtgcgagacgtgcgtgtacaacatgatggggaagcgcgagaagaagctcggcgagttcgggaaggccaagggcagccgggccatctggtacatgtggctgggcgcccgcttcctggagttcgaggcgctcgggttcctgaacgaggaccactggttctcccgggagaacagcctgtccggcgtggagggggagggcctccacaagctggggtacatcctgcgcgacgtcagcaagaaggagggcggcgccatgtacgccgacgacaccgccgggtgggacacccggatcaccctcgaggacctgaagaacgaggagatggtgacgaaccacatggagggcgagcacaagaagctggcggaggccatcttcaagctcacctaccagaacaaggtggtccgcgtgcagcggcccacgccccgggggaccgtgatggacatcatcagccggcgcgaccagcggggctccgggcaggtcggcacgtacggcctgaacaccttcaccaacatggaggcccagctgatccgccagatggagggggagggcgtgttcaagaacatccagcacctcaccgtgacggaggaggccgccgtccagaactggctggcgcgggtggggcgcgagcgcctgagccggatggccatctccggcgacgactgcgtggtcaagcccctcgacgaccgcttcgccaacgccctgaccgccctgaacgacatgggcaagatccggaaggacatccagcagtgggagccgagcaaggggtggaacgactggacccaggtgcccttctgctcccaccacttccacgagctcatcatgaaggacggccgcgtgctggtcgtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtcccgacgagccgcaccacctggtccatccacgccaagcacgagtggatgaccaccgaggacatgctgacggtgtggaaccgggtgtggatccgcgagaacccctggatggaggacaagacccccgtcgagagctgggaggagatcccctacctcggcaagcgggaggaccagtggtgcgggtccctgatcggcctgaccagccgcgccacctgggcgaagaacatccaggccgccatcaaccaggtgcggtccctcatcgggaacgaggagtacacggactacatgccgagcatgaagcgcttccggcgcgaggaggaggaggccggcgtgctgtggtga

SEQ ID NO: 9182 - RNA, 9876 nt, synthetic construct
  misc_feature 1..9876: note = derived and/or modified CDS sequence (opt1) from DENV-2__FJ898460__SS-prME
  source 1..9876: mol_type = other RNA
accgccggcgtgatcgtcatgctgatccccaccgccatcgcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcaacggggtgagctggacgatgaagatcctgatcggcgtcatcatcacctggatcgggatgaactcccgcagcacctccctgagcgtgtccctggtgctcgtcggcgtggtgaccctgtacctgggggccatggtccaggcggacagcggctgcgtggtgtcctggaagaacaaggagctcaagtgcggcagcgggatcttcatcacggacaacgtccacacctggaccgagcagtacaagttccagcccgagtcccccagcaagctggccagcgccatccagaaggcccacgaggagggcatctgcgggatccggtccgtgacccgcctggagaacctcatgtggaagcagatcacgcccgagctgaaccacatcctgagcgagaacgaggtgaagctcaccatcatgaccggcgacatcaaggggatcatgcaggccggcaagcggtccctgcgcccgcagcccaccgagctgaagtacagctggaagacgtggggcaaggcgaagatgctctccaccgagagccacaaccagaccttcctgatcgacgggcccgagaccgccgagtgcccgaacacgaaccgggcctggaactccctggaggtcgaggactacggcttcggggtgttcagcaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagtccttcgccgggcccgtcagccagcacaactaccgcccgggctaccacacccagacggcggggccctggcacctcggcaagctggagatggacttcgacttctgcgaggggaccaccgtggtggtcaccgaggactgcggcaaccggggccccagcctgcgcacgaccaccgcctccgggaagctcatcaccgagtggtgctgccggagctgcacgctgcccccgctgcgctaccggggcgaggacgggtgctggtacggcatggagatccgccccctcaaggagaaggaggagaacctggtgaactccctggtgaccgccgggcacggccagatcgacaacttcagcctcggcgtcctggggatggccctgttcctcgaggagatgctgcggacccgcgtgggcaccaagcacgcgatcctgctcgtggccgtctccttcgtgacgctgatcaccgggaacatgagcttccgggacctgggccgcgtgatggtcatggtgggggccaccatgaccgacgacatcggcatgggcgtgacgtacctcgccctgctggccgcgttcaaggtccgccccaccttcgccgccgggctcctgctgcggaagctcacctccaaggagctgatgatggccaccatcggcatcgccctgctcagccagtccacgatgcccgagaccatcctggagctgaccgacgcgctcgccctggggatgatggtgctgaagatcgtgcgcaacatggagaagtaccagctcgccgtcaccatcatggccatcagctgcgtgccgaacgccgtgatcctgcagaacgcgtggaaggtctcctgcacgatcctggccgccgtgagcgtcagccccctcctgctgaccagctcccagcagaaggccgactggatccccctcgcgctgaccatcaagggcctgaaccccaccgccatcttcctcacgaccctgagccggacctccaagaagcgcagctggccgctgaacgaggccatcatggccgtgggcatggtgtccatcctcgccagcagcctgctgaagaacgacatccccatgaccgggcccctcgtcgcgggcgggctgctgacggtgtgctacgtgctcaccggccggtccgccgacctggagctggagcgcgccgccgacgtcaagtgggaggaccaggccgagatcagcgggtccagccccatcctctccatcaccatcagcgaggacggctccatgagcatcaagaacgaggaggaggagcagaccctgacgatcctgatccggaccggcctcctggtgatctccggggtgttcccggtcagcatccccatcaccgcggccgcctggtacctgtgggaggtgaagaagcagcgcgccggcgtgctctgggacgtccccagcccgccgcccgtggggaaggccgagctggaggacggcgcgtaccggatcaagcagcgcgggatcctgggctacagccagatcggcgccggggtgtacaaggagggcaccttccacaccatgtggcacgtcacgcgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgcggtgcagaccaagcccggcatcttcaagaccaacaccgggacgatcggcgccgtctccctggacttcagccccggcacctccgggagccccatcgtggaccggaagggcaaggtggtcgggctctacggcaacggcgtggtgacccgctccggggcctacgtcagcgccatcgcgcagaccgagaagtccatcgaggacaaccccgagatcgaggacgacatcttccggaagaagcgcctgacgatcatggacctgcaccccggcgccgggaagaccaagcggtacctccccgccatcgtgcgcgaggccatcaagcggggcctgcgcaccctgatcctggccccgacccgcgtggtcgcggccgagatggaggaggccctccgggggctgcccatccgctaccagacgcccgccatccgggccgagcacaccggccgcgagatcgtggacctgatgtgccacgcgaccttcaccatgcggctcctgtcccccgtgcgcgtcccgaactacaacctgatcatcatggacgaggcccacttcacggaccccgccagcatcgccgcccggggctacatctccacccgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgacggacttcaaggggaagaccgtctggttcgtgccgagcatcaaggcgggcaacgacatcgccgcctgcctccgcaagaacggcaagaaggtgatccagctgtcccggaagaccttcgacagcgagtacgtcaagacccgcgccaacgactgggacttcgtggtgacgaccgacatctccgagatgggggccaacttcaaggcggagcgggtcatcgacccccgccggtgcatgaagcccgtgatcctgaccgacggcgaggagcgcgtgatcctcgccgggcccatgccggtcacccacagctccgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacgcccgagggcatcatcccgagcatgttcgagcccgagcgcgagaaggtggacgccatcgacggggagtaccggctgcgcggcgaggcccggaagaccttcgtggacctgatgcgccgcggggacctccccgtctggctggcctacaaggtggccgcggagggcatcaactacgccgaccgcaagtggtgcttcgacgggatcaagaacaaccagatcctggaggagaacgtggaggtcgagatctggaccaaggagggcgagcggaagaagctcaagccgcgctggctggacgcccggatctactccgaccccctggccctcaaggagttcaaggagttcgcggccggccgcaagagcctgaccctgaacctcatcacggagatggggcggctgcccaccttcatgacccagaaggcccgcaacgccctggacaacctcgccgtgctgcacaccgcggaggccggcgggcgggcctacaaccacgccctgtccgagctccccgagacgctggagaccctgctcctgctgaccctcctggccaccgtcacgggcggcatcttcctgttcctcatgagcgggaagggcatcgggaagatgaccctgggcatgtgctgcatcatcaccgcgtccatcctgctctggtacgcccagatccagccgcactggatcgccgccagcatcatcctggagttcttcctgatcgtgctcctgatccccgagcccgagaagcagcgcacgccccaggacaaccagctgacctacgtggtcatcgccatcctcacggtggtggcggccaccatggccaacgagatggggttcctggagaagaccaagaaggacctgggcctcggcagcatcaccacgcaggagtccgagagcaacatcctggacatcgacctgcggccggcctccgcctggaccctctacgcggtcgccaccaccttcgtgacgcccatgctgcgccacagcatcgagaactccagcgtgaacgtctccctgaccgccatcgccaaccaggcgaccgtgctcatggggctgggcaaggggtggcccctgagcaagatggacatcggcgtgcccctcctggccatcgggtgctactcccaggtcaacccgatcaccctgacggccgccctcctgctgctcgtggcccactacgcgatcatcggccccggcctgcaggccaaggccacccgggaggcccagaagcgcgccgcggccgggatcatgaagaaccccaccgtggacggcatcaccgtcatcgacctggagcccatcccgtacgaccccaagttcgagaagcagctcgggcaggtcatgctgctgatcctctgcgtgacgcaggtcctgatgatgcggaccacctgggccctgtgcgaggccctcaccctggccacgggccccatcagcaccctgtgggaggggaaccccggccgcttctggaacaccaccatcgcggtgtccatggccaacatcttccgcggcagctacctcgccggggccggcctgctgttctccatcatgaagaacacgaccaacacccggcgcgggaccggcaacatcggcgagacgctcggggagaagtggaagtcccggctgaacgcgctgggcaagtccgagttccagatctacaagaagtccgggatccaggaggtggaccgcaccctcgccaaggagggcatcaagcgcggggagaccgaccaccacgccgtctcccgcggcagcgccaagctgcggtggttcgtggagcgcaacatggtgaccccggagggcaaggtcgtggacctggggtgcggccgcggcgggtggtcctactactgcggcgggctcaagaacgtgcgcgaggtcaaggggctgacgaagggcggccccgggcacgaggagcccgtgcccatgagcacctacggctggaacctggtgcggctccagagcggggtcgacgtgttcttcaccccgcccgagaagtgcgacaccctgctgtgcgacatcggcgagtccagccccaaccccacgatcgaggccggccgcaccctccgggtgctgaacctggtcgagaactggctcaacaacaacacccagttctgcatcaaggtgctgaacccgtacatgccctccgtgatcgagaagatggagaccctgcagcgcaagtacgggggcgcgctcgtccggaaccccctgagccgcaactccacccacgagatgtactgggtgagcaacgccacggggaacatcgtgtccagcgtcaacatgatctcccggatgctgatcaaccgcttcaccatgaagcacaagaaggccacctacgagccggacgtggacctgggcagcgggacccggaacatcggcatcgagtccgagacgcccaacctcgacatcatcggcaagcgcatcgagaagatcaagcaggagcacgagaccagctggcactacgaccaggaccacccctacaagacctgggcctaccacgggtcctacgagaccaagcagacgggcagcgcctccagcatggtgaacggggtcgtgcgcctgctgaccaagccctgggacgtggtcccgatggtgacccagatggcgatgaccgacacgacccccttcggccagcagcgggtgttcaaggagaaggtcgacacccgcacccaggagcccaaggagggcacgaagaagctcatgaagatcaccgccgagtggctgtggaaggagctggggaagaagaagacgccccggatgtgcacccgcgaggagttcacgaagaaggtgcggtccaacgccgccctcggcgccatcttcaccgacgagaacaagtggaagtccgcgcgcgaggccgtggaggacgggcggttctgggagctggtcgaccgcgagcggaacctgcacctcgagggcaagtgcgagacctgcgtgtacaacatgatggggaagcgcgagaagaagctgggcgagttcggcaaggccaaggggtcccgggccatctggtacatgtggctgggcgcgcgcttcctcgagttcgaggccctggggttcctgaacgaggaccactggttcagccggggcaacagcctctccggggtcgagggcgagggcctgcaccgcctggggtacatcctccgggaggtgggcaagaaggagggcggcgccatgtacgccgacgacaccgccgggtgggacacgcgcatcaccctggaggacctgaagaacgaggagatggtgaccaaccacatgaagggcgagcacaagaagctcgcggaggccatcttcaagctgacctaccagaacaaggtcgtgcgggtgcagcgcccgacgccccggggcaccgtcatggacatcatcagccgccgggaccagcgcgggtccggccaggtggggacctacggcctgaacaccttcacgaacatggaggcccagctcatccgccagatggagggcgaggggatcttcaagagcatccagcacctgaccgccaccgaggagatcgccgtgcagaactggctggcgcgggtcggccgcgagcggctctcccgcatggccatcagcggggacgactgcgtggtgaagcccatcgacgaccggttcgcctccgccctgaccgccctgaacgacatgggcaaggtccgcaaggacatccagcagtgggagcccagccgggggtggaacgactggacccaggtgccgttctgctcccaccacttccacgagctcgtgatgaaggacggccgcgtcctggtggtgccctgccggaaccaggacgagctgatcggccgcgcgcggatcagccagggggccggctggtccctcaaggagaccgcctgcctgggcaagagctacgcccagatgtggaccctgatgtacttccaccgccgggacctccgcctggccgcgaacgccatctgctccgccgtccccagccactgggtgcccacctcccggaccacgtggagcatccacgccaagcacgagtggatgaccaccgaggacatgctggcggtgtggaaccgcgtctggatccaggagaacccgtggatggaggacaagacccccgtggagtcctgggaggaggtgccctacctcggcaagcgggaggaccagtggtgcgggagcctgatcggcctgacgagccgcgccacctgggccaagaacatccagaccgccatcaaccaggtccggtccctcatcggcaacgaggagtacaccgactacatgcccagcatgaagcgcttccgccgggaggaggaggaggccggggtgctgtggtga

SEQ ID NO: 9183 - RNA, 9876 nt, synthetic construct
  misc_feature 1..9876: note = derived and/or modified CDS sequence (opt1) from DENV-2__FJ882602__SS-prME
  source 1..9876: mol_type = other RNA
accgcgggcatgatcatcatgctgatccccaccgccatggcgttccacctcaccacccgcaacggggagccccacatgatcgtgagccggcaggagaagggcaagagcctgctgttcaagaccgaggacggggtcaacatgtgcaccctcatggccatggacctgggcgagctgtgcgaggacaccatcacctacaactgccccctcctgcgccagaacgagcccgaggacatcgactgctggtgcaacagcacctccacctgggtgacctacgggacctgcaccgccaccggcgagcaccggcgcgagaagcggagcgtggccctggtcccccacgtgggcatggggctcgagacccgcaccgagacctggatgtccagcgagggcgcctggaagcacgcgcagcggatcgagacctggatcctgcgccaccccgggttcaccatcatggccgccatcctggcctacaccatcggcaccacctacttccagcgggtgctcatcttcatcctgctgacggcggtcgccccctccatgaccatgcgctgcatcgggatcagcaaccgggacttcgtggagggcgtgtccggcgggagctgggtcgacatcgtgctcgagcacggctcctgcgtgaccaccatggccaagaacaagcccacgctggacttcgagctgatcaagaccgaggccaagcagcccgccaccctccgcaagtactgcatcgaggcgaagctgaccaacacgaccaccgccagccggtgcccgacccagggggagccctccctgaacgaggagcaggacaagcgcttcgtctgcaagcacagcatggtggaccggggctggggcaacgggtgcggcctcttcgggaagggcgggatcgtgacgtgcgccatgttcacgtgcaagaagaacatggagggcaagatcgtccagcccgagaacctggagtacaccatcgtgatcacgccccactccggcgaggagaacgccgtggggaacgacacgggcaagcacgggaaggagatcaaggtcaccccgcagagctccatcaccgaggccgagctgaccggctacgggaccgtgacgatggagtgcagcccccgcaccggcctcgacttcaacgagatggtgctgctgcagatggagaacaaggcgtggctcgtccaccggcagtggttcctggacctgcccctcccctggctgccgggcgccgacacccaggggtccaactggatccagaaggagaccctggtgacgttcaagaacccccacgccaagaagcaggacgtggtcgtgctcggcagccaggagggggccatgcacaccgccctgaccggcgcgaccgagatccagatgagctccgggaacctcctgttcacgggccacctgaagtgccgcctgcggatggacaagctccagctgaagggcatgagctactccatgtgcaccgggaagttcaaggtcgtgaaggagatcgccgagacccagcacggcaccatcgtgatccgcgtccagtacgagggggacggcagcccctgcaagatccccttcgagatcatggacctggagaagcggcacgtgctcggccgcctgatcacggtgaacccgatcgtcaccgagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcggatggccatcctgggcgacacggcgtgggacttcgggagcctgggcggggtcttcacctccatcggcaaggccctccaccaggtgttcggggccatctacggcgccgcgttcagcggcgtgtcctggaccatgaagatcctgatcggggtcgtgatcacctggatcggcatgaacagccgctccacgagcctgtccgtggccctggtcctcgtgggggtggtcaccctgtacctgggcgtgatggtgcaggccgacagcgggtgcgtcgtgtcctggaagaacaaggagctcaagtgcggcagcggcatcttcatcaccgacaacgtgcacacctggacggagcagtacaagttccagcccgagagcccctccaagctggccagcgccatccagaaggcgcacgaggaggggatctgcggcatccggtccgtcacccgcctggagaacctcatgtggaagcagatcacccccgagctgaaccacatcctgagcgagaacgaggtgaagctcaccatcatgacgggggacatcaagggcatcatgcaggccgggaagcggtccctgcgcccgcagcccaccgagctgaagtacagctggaagacctggggcaaggccaagatgctctccaccgagccccacaaccagacgttcctgatcgacggcccggagaccgccgagtgccccaacaccaaccgggcctggaacagcctggaggtggaggactacgggttcggcgtcttcaccacgaacatctggctcaagctgaaggagcgccaggacgtgttctgcgactccaagctgatgagcgcggccatcaaggacaaccgggccgtgcacgccgacatggggtactggatcgagtccgccctcaacgacacctggaagatcgagaaggcgagcttcatcgaggtcaagtcctgccactggcccaagagccacaccctgtggtccaacggcgtgctggagagcgagatgatcatccccaagaacttcgccggcccggtgtcccagcacaactaccgccccgggtaccacacccagaccgccggcccctggcacctcgggaagctggagatggacttcgacttctgcgagggcacgaccgtcgtggtgaccgaggactgcgggaaccggggccccagcctgcgcaccacgaccgccagcggcaagctcatcaccgagtggtgctgccggtcctgcaccctgccgcccctgcgctaccgcggggacgacggctgctggtacgggatggagatccgccccctcaaggagaaggaggagaacctggtcaacagcctggtgacggcgggctacgggcagatcgacaacttctccctcggcgtgctgggcatggccctgttcctcgaggagatgctgcggacccgcgtcgggaccaagcacgccgtgctgctcgtggccgtcagcttcatgaccctgatcacgggcaacatgtccttccgggacctggggcgcgtggtggtcatggtgggcgccgcgatgaccgacgacatcgggatgggcgtgacctacctcgccctgctggccgccttcaaggtccgccccaccttcgccgcgggcctcctgctgcggaagctcacgagcaaggagctgatgatgaccaccatcgggatcgtgctgctctcccagagcaccatcccggagacgatcctggagctgaccgacgccctcgccctgggcatgatgatcctgaagatcgtgcgcaacatggagaagtaccagctcgccgtcaccatcatggccatcctgtgcgtgcccaacgcggtcatcctgcagaacgcctggaaggtgtcctgcaccatcctcgccgtggtcagcgtgagccccctgctgctcacgagctcccagcagaaggccgactggatccccctggcgctgaccatcaaggggctcaacccgaccgccatcttcctgaccacgctgagccggaccaacaagaagcgctcctggcccctcaacgaggccatcatggccgtgggcatggtcagcatcctggcctccagcctgctcaagaacgacatccccatgaccggccccctggtggccggcgggctgctcaccgtgtgctacgtcctgacggggcggtccgccgacctggagctcgagcgcgccgccgacgtgcggtgggaggaccaggccgagatcagcgggagctccccgatcctgagcatcaccatctccgaggacgggagcatgtccatcaagaacgaggaggaggagcagaccctgaccatcctcatccgcacgggcctgctggtgatcagcggcctcttccccgtctccatccccatcaccgcggccgcctggtacctgtgggaggtgaagaagcagcgggccggggtgctgtgggacgtccccagcccgccgcccgtgggcaaggccgagctcgaggacggggcgtaccgcatcaagcagaagggcatcctggggtactcccagatcggcgccggcgtgtacaaggaggggaccttccacaccatgtggcacgtcacccggggcgccgtgctgatgcacaaggggaagcgcatcgagccgagctgggccgacgtgcggaaggacctcatctcctacggcgggggctggaagctggagggcgagtggaaggagggggaggaggtccaggtgctggccctcgagcccggcaagaacccccgcgcggtgcagacgaagcccgggctgttcaagaccaacaccggcaccatcggggccgtcagcctggacttctccccgggcacgagcggctcccccatcgtggacaagaaggggaaggtggtcggcctctacgggaacggcgtggtgacccggagcggcacctacgtctccgccatcgcccagaccgagaagtccatcgaggacaaccccgagatcgaggacgacatcttccgcaagcggcgcctgacgatcatggacctgcaccccggggcgggcaagaccaagcggtacctgccggccatcgtgcgcgaggccatcaagcgggggctccgcaccctgatcctggcccccacccgcgtggtcgccgcggagatggaggaggccctccggggcctgcccatccgctaccagacgcccgccatccgggccgagcacaccgggcgcgagatcgtggacctgatgtgccacgccaccttcaccatgcggctcctgtccccggtgcgcgtccccaactacaacctgatcatcatggacgaggcgcacttcacggaccccgccagcatcgccgcccggggctacatcagcacccgcgtggagatgggcgaggccgcggggatcttcatgaccgccacgccgcccggctcccgggaccccttcccccagagcaacgcccccatcatggacgaggagcgcgagatccccgagcggtcctggaacagcgggcacgagtgggtgacggacttcaagggcaagaccgtctggttcgtgccctccatcaaggccgggaacgacatcgcggcctgcctccgcaagaacggcaagaaggtgatccagctgagccggaagaccttcgactccgagtacatcaagacccgcacgaacgactgggacttcgtcgtgaccaccgacatcagcgagatgggcgccaacttcaaggccgagcgggtgatcgacccccgccggtgcatgaagcccgtcatcctgaccgacggggaggagcgcgtgatcctcgccggcccgatgcccgtgacgcactccagcgcggcccagcggcgcgggcgcatcggccggaaccccaagaacgagaacgaccagtacatctacatgggggagcccctggagaacgacgaggactgcgcccactggaaggaggccaagatgctgctcgacaacatcaacaccccggagggcatcatcccctccatgttcgagcccgagcgcgagaaggtcgacgccatcgacggcgagtaccggctgcgcggggaggcgcggaagaccttcgtggacctgatgcgccggggcgacctcccggtgtggctggcctaccgcgtcgccgccgaggggatcaactacgccgaccggcgctggtgcttcgacggcatcaagaacaaccagatcctggaggagaacgtggaggtcgagatctggaccaaggagggggagcggaagaagctcaagccccgctggctggacgcgcggatctacagcgaccccctggccctcaaggagttcaaggagttcgccgccggccgcaagtccctgacgctgaacctcatcaccgagatgggccggctgcccaccttcatgacccagaaggcgcgcaacgccctggacaacctcgccgtgctgcacacggccgaggccgggggccgggcgtacaaccacgccctgagcgagctcccggagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcccagatccagccccactggatcgcggcctccatcatcctggagttcttcctgatcgtcctcctgatccccgagcccgagaagcagcgcaccccgcaggacaaccagctgacgtacgtggtgatcgccatcctcaccgtcgtggccgccaccatggcgaacgagatgggcttcctggagaagaccaagaaggacctggggctcggcagcatcgccacgcagcagcccgagtccaacatcctggacatcgacctgcggcccgccagcgcctggaccctctacgccgtggcgaccaccttcatcacgcccatgctgcgccacagcatcgagaactccagcgtcaacgtgtccctgaccgccatcgccaaccaggccaccgtgctcatgggcctggggaagggctggccgctgagcaagatggacatcggggtccccctcctggcgatcggctgctactcccaggtgaaccccatcaccctgacggccgccctcctgctgctcgtggcccactacgccatcatcgggcccggcctgcaggcgaaggccacccgggaggcccagaagcgcgccgccgcgggcatcatgaagaacccgaccgtcgacgggatcaccgtgatcgacctggaccccatcccctacgaccccaagttcgagaagcagctcggccaggtgatgctgctggtcctctgcgtgacccaggtgctgatgatgcgcaccacctgggccctgtgcgaggccctcaccctggccacggggccgatcagcaccctgtgggagggcaaccccgggcggttctggaacaccaccatcgccgtctccatggcgaacatcttccgcggcagctacctcgccggcgccgggctgctgttctccatcatgaagaacacgaccaacacccggcgcggcaccgggaacacgggcgagaccctcggcgagaagtggaagaaccggctgaacgccctgggcaagagcgagttccagatctacaagaagtccggcatccaggaggtggaccgcaccctcgcgaaggaggggatcaagcggggcgagaccgaccaccacgccgtgagccgcgggtccgccaagctgcggtggttcgtcgagcgcaacctggtgacgcccgagggcaaggtggtcgacctcggctgcgggcggggcgggtggagctactactgcggcgggctgaagaacgtgcgcgaggtgaagggcctgaccaagggcgggcccggccacgaggagccgatccccatgtccacctacgggtggaacctcgtccggctgcagagcggcgtggacgtgttcttcacgccgcccgagaagtgcgacacgctgctctgcgacatcggggagtccagcccgaaccccaccgtcgaggccggccgcaccctgcgggtgctgaacctcgtggagaactggctgaacaacaacacccagttctgcatcaaggtcctgaacccctacatgccgtccgtgatcgagaagatggaggccctgcagcgcaagtacggcggggcgctcgtgcggaaccccctgagccgcaacagcacccacgagatgtactgggtctccaacgccagcggcaacatcgtgtccagcgtgaacatgatctcccggatgctgatcaaccgcttcacgatgcgccacaagaaggccacctacgagcccgacgtcgacctcgggagcggcacccggaacatcgggatcgagtccgagacccccaacctggacatcatcggcaagcgcatcgagaagatcaagcaggagcacgagacgagctggcactacgaccaggaccacccgtacaagacctgggcctaccacggctcctacgagaccaagcagaccgggagcgcctccagcatggtgaacggcgtggtccggctgctcacgaagccctgggacgtgatccccatggtgacccagatggcgatgaccgacaccacgcccttcgggcagcagcgcgtcttcaaggagaaggtggacacccggacccaggagccgaaggagggcaccaagaagctgatgaagatcacggccgagtggctgtggaaggagctcggcaagaagaagacgccccggatgtgcacccgggaggagttcacccgcaaggtgcggtccaacgccgccctgggggccatcttcacggacgagaacaagtggaagtccgcgcgcgaggccgtcgaggactcccggttctgggagctggtggacaaggagcgcaacctccacctggagggcaagtgcgagacctgcgtctacaacatgatggggaagcgggagaagaagctgggcgagttcgggaaggccaagggcagccgcgccatctggtacatgtggctcggcgcgcggttcctggagttcgaggccctggggttcctcaacgaggaccactggttctcccgcgagaacagcctgtccggcgtggagggggagggcctgcacaagctcgggtacatcctgcgggacgtgagcaagaaggagggcggcgccatgtacgccgacgacaccgccgggtgggacacccgcatcacgctggaggacctcaagaacgaggagatggtcaccaaccacatggagggcgagcacaagaagctggcggaggccatcttcaagctgacctaccagaacaaggtggtgcgggtccagcgccccacgccccgggggacggtgatggacatcatcagccgccgcgaccagcggggctccggccaggtggggacctacggcctcaacaccttcaccaacatgggggcccagctgatccgccagatggagggcgaggaggtcttcaaggggatccagcacctgacggccaccgaggagatcgccgtgcagaactggctcgcgcgggtgggccgcgagcggctgagccgcatggccatctccggcgacgactgcgtcgtgaagccgctggacgaccggttcgccagcgccctcaccgccctgaacgacatggggaaggtgcgcaaggacatccagcagtgggagccctcccggggctggaacgactggacccaggtccccttctgcagccaccacttccacgagctgatcatgaaggacgggcgcgtgctcgtggtcccctgccggaaccaggacgagctgatcggccgcgcgcggatctcccagggggccggctggagcctgcgcgagacggcctgcctcggcaagtcctacgcccagatgtggagcctgatgtacttccaccggcgcgacctgcggctcgccgcgaacgccatctgctccgccgtgccgagccactgggtgcccacctcccgcaccacctggagcatccacgcccggcacgagtggatgaccacggaggacatgctgaccgtctggaaccgcgtgtggatccaggagaacccctggatggaggacaagacccccgtggagtcctgggaggagatcccgtacctggggaagcgcgaggaccagtggtgcggcagcctcatcgggctgacctcccgggcgacgtgggccaagaacatccagaccgccatcaaccaggtccgcagcctgatcggcaacgaggagtacaccgactacatgcccagcatgaagcggttccgccgggaggaggaggaggccggggtgctctggtga

SEQ ID NO: 9184 - RNA, 9876 nt, synthetic construct
  misc_feature 1..9876: note = derived and/or modified CDS sequence (opt1) from DENV-2__GQ252676__SS-prME
  source 1..9876: mol_type = other RNA
accgcgggcgtgatcatcatgctgatccccaccgccatggcgttccacctcaccacccgcaacggggagccccacatgatcgtgagcaagcaggagaagggcaagtccctgctgttcaagaccgaggagggggtgaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccgccgggagaagcgcagcgtcgccctggtgccccacgtgggcatggggctcgagacccggaccgagacctggatgtccagcgagggcgcctggaagcacgcgcagcgcatcgagacctggatcctgcggcaccccgggttcaccatcatggccgccatcctggcctacaccatcggcaccacctacttccagcgcgtcctcatcttcatcctgctgacggcggtggccccctccatgaccatgcggtgcatcgggatcagcaaccgcgacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccggaagtactgcatcgaggcgaagctgaccaacacgaccaccgccagccgctgcccgacccagggggagccctccctgaacgaggagcaggacaagcggttcgtgtgcaagcacagcatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccggaccggcctcgacttcaacgagatggtgctgctgcagatggagaacaaggcgtggctcgtgcaccgccagtggttcctggacctgcccctcccctggctgccgggcgccgacatccaggggtccaactggatccagaaggagaccctggtcaccttcaagaacccccacgccaagaagcaggacgtggtcgtgctcggcagccaggagggggccatgcacacggccctgaccggcgcgaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtggtgcgggtccagtacgagggggacggcagcccctgcaagatccccttcgagatcatggacctggagaagcgccacgtgctcggccggctgatcaccgtgaacccgatcgtcacggagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcgcatggccatcctgggcgacaccgcgtgggacttcgggagcctgggcggggtcttcacgtccatcggcaaggccctccaccaggtgttcggggccatctacggcgccgcgttcagcggcgtgtcctggaccatgaagatcctgatcggggtcgtgatcacctggatcggcatgaacagccggtccaccagcctgtccgtgagcctggtcctcgtgggggtggtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcccacgaggaggggatctgcggcatccgcagcgtcacgcggctggagaacctcatgtggaagcagatcacccccgagctgaaccacatcctgtccgagaacgaggtgaagctcagcatcatgaccggggacatcaagggcatcatgcaggcggggaagcgctccctgcggccgcagcccaccgagctgaagtacagctggaagacgtggggcaaggccaagatgctctccaccgagccccacaaccagaccttcctgatcgacggcccggagaccgccgagtgccccaacacgaaccgcgcctggaacagcctggaggtggaggactacgggttcggcgtcttcaccaccaacatctggctcaagctgaaggagcggcaggacgtgttctgcgactccaagctgatgagcgccgcgatcaaggacaaccgcgccgtgcacgccgacatggggtactggatcgagtccgccctcaacgacacctggaagatcgagaaggccagcttcatcgaggtcaagtcctgccactggcccaagagccacacgctgtggtccaacggcgtgctggagagcgagatgatcatccccaagaacttcgcgggcccggtgagccagcacaactaccggcccgggtaccacacccagaccgccggcccctggcacctcgggaagctggagatggacttcgacttctgcgagggcaccaccgtcgtggtgacggaggactgcgggaaccgcggcccctccctgcggaccaccaccgccagcggcaagctcatcacggagtggtgctgccgctcctgcaccctgccgcccctgcggtaccgcggggaggacggctgctggtacgggatggagatccggcccctcaaggagaaggaggagaacctggtcaacagcctggtgaccgccggccacgggcagatcgacaacttctccctcggcgtgctgggcatggcgctgttcctcgaggagatgctgcgcacccgggtcgggacgaagcacgccgtgctgctcgtggccgtcagcttcatgaccctgatcaccggcaacatgtccttccgcgacctggggcgggtgatggtgatggtcggcgccgccatgaccgacgacatcgggatgggcgtgacgtacctcgcgctgctggccgccttcaaggtgcgccccaccttcgccgccggcctcctgctgcgcaagctcaccagcaaggagctgatgatgaccacgatcgggatcgtcctgctctcccagagcaccatcccggagaccatcctggagctgaccgacgcgctcgccctgggcatgatgatcctgaagatcgtgcggaacatggagaagtaccagctcgccgtcacgatcatggccatcctgtgcgtgcccaacgccgtgatcctgcagaacgcgtggaaggtctcctgcaccatcctcgccgccgtgagcgtgagccccctgctgctcaccagctcccagcagaaggccgactggatccccctggcgctgaccatcaaggggctcaacccgacggccatcttcctgaccaccctgagccgcaccaacaagaagcggtcctggcccctcaacgaggccatcatggccgtcggcatggtgagcatcctggcctccagcctgctcaagaacgacatccccatgacgggccccctggtggccggcgggctgctcaccgtctgctacgtgctgaccgggcgcagcgccgacctggagctcgagcgggccgccgacgtgcgctgggaggaccaggccgagatctccgggagctccccgatcctgagcatcaccatctccgaggacgggagcatgtccatcaagaacgaggaggaggagcagacgctgaccatcctcatccggaccggcctgctggtcatcagcggcctcttccccgtgtccatccccatcaccgcggccgcctggtacctgtgggaggtgaagaagcagcgcgccggggtcctgtgggacgtgcccagcccgccgcccgtgggcaaggccgagctcgaggacggggcgtaccggatcaagcagaagggcatcctggggtactcccagatcggcgccggcgtctacaaggaggggacgttccacaccatgtggcacgtgacccgcggcgccgtgctgatgcacaaggggaagcggatcgagccgagctgggccgacgtccgcaaggacctcatctcctacggcgggggctggaagctggagggcgagtggaaggagggggaggaggtccaggtgctggccctcgagcccggcaagaacccccgggcggtccagaccaagcccgggctgttcaagaccaacacgggcaccatcggggccgtgagcctggacttctccccgggcaccagcggctcccccatcgtggacaagaaggggaaggtcgtgggcctctacgggaacggcgtggtcacccgcagcggcacgtacgtgtccgccatcgcccagaccgagaagtccatcgaggacaaccccgagatcgaggacgacatcttccggaagaagcgcctgaccatcatggacctgcaccccggggcgggcaagaccaagcggtacctgccggccatcgtgcgcgaggccatcaagcgggggctccgcacgctgatcctggcccccacccgggtcgtggccgcggagatggaggaggccctccgcggcctgcccatccgctaccagacccccgccatccgggccgagcacaccgggcgcgagatcgtggacctgatgtgccacgccacgttcaccatgcggctcctgagcccggtccgcgtgcccaactacaacctgatcatcatggacgaggcgcacttcaccgaccccgcctccatcgccgcccggggctacatcagcacccgcgtggagatgggcgaggccgcggggatcttcatgacggccacgccgcccggctcccgggaccccttcccccagagcaacgcccccatcatggacgaggagcgcgagatccccgagcggtcctggaacagcgggcacgagtgggtcaccgacttcaagggcaagaccgtgtggttcgtgccctccatcaaggccgggaacgacatcgcggcctgcctccgcaagaacggcaagaaggtcatccagctgagccggaagacgttcgactccgagtacatcaagacccgcaccaacgactgggacttcgtggtgaccacggacatcagcgagatgggcgccaacttcaaggccgagcgggtcatcgacccccgccggtgcatgaagcccgtgatcctgaccgacggggaggagcgcgtgatcctcgccggcccgatgcccgtcacccactccagcgcggcccagcggcgcgggcggatcggccgcaaccccaagaacgagaacgaccagtacatctacatgggggagcccctggagaacgacgaggactgcgcccactggaaggaggccaagatgctgctcgacaacatcaacaccccggagggcatcatcccctccatgttcgagcccgagcgcgagaaggtggacgccatcgacggcgagtaccggctgcgcggggaggcgcggaagacgttcgtggacctgatgcgccggggcgacctcccggtctggctggcctaccgcgtggccgccgaggggatcaactacgccgaccggcgctggtgcttcgacggcatcaagaacaaccagatcctggaggagaacgtcgaggtggagatctggaccaaggagggggagcggaagaagctcaagccccgctggctggacgcgcggatctacagcgaccccctggccctcaaggagttcaaggagttcgccgccggccgcaagtccctgaccctgaacctcatcaccgagatgggccggctgcccacgttcatgacccagaaggcgcgcaacgccctggacaacctcgccgtgctgcacaccgccgaggccgggggccgggcgtacaaccacgccctgagcgagctcccggagaccctggagacgctgctcctgctgaccctcctggccaccgtcaccgggggcatcttcctgttcctcatgtccggcaaggggatcggcaagatgacgctggggatgtgctgcatcatcaccgccagcatcctgctctggtacgcccagatccagccccactggatcgcggcctccatcatcctggagttcttcctgatcgtgctcctgatccccgagcccgagaagcagcgcaccccgcaggacaaccagctgacctacgtggtcatcgccatcctcaccgtggtggccgccacgatggcgaacgagatgggcttcctggagaagaccaagaaggacttcgggctgggcagcatcgccacccagcagcccgagagcaacatcctcgacatcgacctgcggcccgcctccgcctggaccctgtacgccgtcgcgacgaccttcatcacccccatgctccgccacagcatcgagaactccagcgtgaacgtgtccctgaccgccatcgccaaccaggccacggtcctgatgggcctcgggaagggctggccgctgagcaagatggacatcggggtgcccctgctcgcgatcggctgctactcccaggtgaaccccatcaccctgaccgccgccctgctcctgctggtcgcccactacgccatcatcgggcccggcctccaggcgaaggccacccgggaggcccagaagcgcgccgccgcgggcatcatgaagaacccgacggtggacgggatcaccgtgatcgacctggaccccatcccctacgaccccaagttcgagaagcagctgggccaggtcatgctcctggtgctgtgcgtgacccaggtcctcatgatgcggaccacgtgggccctgtgcgaggccctgaccctcgccaccgggccgatcagcaccctgtgggagggcaaccccgggcgcttctggaacacgaccatcgccgtgtccatggcgaacatcttccgcggcagctacctggccggcgccgggctcctgttctccatcatgaagaacaccaccaacacgcggcgcggcaccgggaacaccggcgagaccctgggcgagaagtggaagaaccggctcaacagcctggggaagtccgagttccagatctacaagcgcagcggcatccaggaggtggaccggacgctggccaaggaggggatcaagcgcggcgagaccgaccaccacgcggtctcccgggggagcgccaagctccgctggttcgtggagcggaacctggtgacccccgagggcaaggtcgtggacctgggctgcgggcgcggcgggtggtcctactactgcggcgggctcaagaacgtgcgggaggtcaagggcctgaccaagggcgggcccggccacgaggagccgatccccatgagcacgtacgggtggaacctggtgcgcctccagtccggcgtggacgtcttcttcacgccgcccgagaagtgcgacaccctgctgtgcgacatcggggagagcagcccgaaccccaccgtggaggccggccggacgctccgcgtgctgaacctggtcgagaactggctcaacaacaacacccagttctgcatcaaggtgctgaacccctacatgccgtccgtgatcgagaagatggagaccctgcagcggaagtacggcggggccctggtccgcaaccccctcagccggaactccacccacgagatgtactgggtgagcaacgcctccggcaacatcgtgagctccgtcaacatgatcagccgcatgctgatcaaccggttcaccatgcgccacaagaaggcgacgtacgagcccgacgtggacctggggtccggcacccgcaacatcgggatcgagagcgagacccccaacctcgacatcatcggcaagcggatcgagaagatcaagcaggagcacgagacctcctggcactacgaccaggaccacccgtacaagacgtgggcctaccacggcagctacgagaccaagcagaccgggtccgccagctccatggtgaacggcgtcgtgcgcctgctgaccaagccctgggacgtgatccccatggtcacgcagatggccatgaccgacaccacccccttcgggcagcagcgggtgttcaaggagaaggtggacacgcgcacccaggagccgaaggagggcaccaagaagctcatgaagatcaccgccgagtggctgtggaaggagctgggcaagaagaagacgccccggatgtgcacccgcgaggagttcgcgcggaaggtccgcagcaacgccgccctcggggccatcttcaccgacgagaacaagtggaagtccgcccgggaggcggtggaggacagccgcttctgggagctggtcgacaaggagcggaacctgcacctcgagggcaagtgcgagacctgcgtgtacaacatgatggggaagcgcgagaagaagatcggcgagttcgggaaggccaagggctcccgggccatctggtacatgtggctgggcgcccgcttcctggagttcgaggcgctcgggttcctgaacgaggaccactggttcagccgggagaacagcctgtccggcgtggagggggagggcctccacaagctggggtacatcctgcgcgaggtcagcaagaaggagggcggcgccatgtacgccgacgacacggccgggtgggacacccggatcaccctcgaggacctgaagaacgaggagatggtgaccaaccacatggagggcgagcacaagaagctggccgaggcgatcttcaagctcacgtaccagaacaaggtggtccgcgtgcagcggcccacgccccgcgggaccgtgatggacatcatctcccggcgcgaccagcgcggcagcgggcaggtcggcacctacggcctgaacacgttcaccaacatgggggcccagctgatccggcagatggagggcgagggggtgttcaagggcatccagcacctcaccgccaccgaggaggtggccgtccaggactggctggcccgcgtgggccgggagcgcctgtcccggatggcgatcagcggggacgactgcgtggtcaagccgctcgacgaccgcttcgcctccgccctgacggccctgaacgacatgggcaaggtgcggaaggacatccagcagtgggagcccagccgcgggtggaacgactggacccaggtgcccttctgctcccaccacttccacgagctcatcatgaaggacggccgggtcctggtggtgccctgccgcaaccaggacgagctgatcgggcgggcccgcatcagccagggcgcgggctggtccctccgggagaccgcctgcctgggcaagagctacgcccagatgtggtccctgatgtacttccaccgccgggacctccgcctggccgccaacgcgatctgcagcgccgtcccgtcccactgggtgcccaccagccggacgacctggtccatccacgcccgccacgagtggatgaccaccgaggacatgctgaccgtgtggaaccgggtctggatccaggagaacccctggatggaggacaagacgcccgtggagagctgggaggagatcccgtacctcggcaagcgcgaggaccagtggtgcgggagcctgatcggcctgacctcccgcgccacctgggcgaagaacatccagaccgccatcaaccaggtgcggagcctcatcgggtccgaggagtacacggactacatgcccagcatgaagcgcttccggcgcgaggaggaggaggccggcgtcctgtggtga

SEQ ID NO: 9185 - RNA, 9876 nt, synthetic construct
  misc_feature 1..9876: note = derived and/or modified CDS sequence (opt1) from DENV-2__GQ252677__SS-prME
  source 1..9876: mol_type = other RNA
accgcgggcgtgatcatcatgctgatccccaccgccatggcgttccacctcaccacccgcaacggggagccccacatgatcgtgagcaagcaggagaagggcaagtccctgctgttcaagaccgaggagggggtgaacatgtgcaccctcatggccatggacctgggcgagctgtgcgaggacaccatcacctacaactgccccctcctgcggcagaacgagcccgaggacatcgactgctggtgcaacagcacctccacctgggtgacctacgggacctgcaccgccaccggcgagcaccgccgggagaagcgcagcgtcgccctggtgccccacgtgggcatggggctcgagacccggaccgagacctggatgtccagcgagggcgcctggaagcacgcgcagcgcatcgagacctggatcctgcggcaccccgggttcaccatcatggccgccatcctggcctacaccatcggcaccacctacttccagcgcgtcctcatcttcatcctgctgacggcggtggccccctccatgaccatgcggtgcatcgggatcagcaaccgcgacttcgtggagggcgtctccggcgggagctgggtggacatcgtgctcgagcacggctcctgcgtcaccaccatggccaagaacaagcccacgctggacttcgagctgatcaagaccgaggccaagcagcccgccaccctccggaagtactgcatcgaggcgaagctgaccaacacgaccaccgccagccgctgcccgacccagggggagccctccctgaacgaggagcaggacaagcggttcgtgtgcaagcacagcatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccactccggcgaggagaacgccgtggggaacgacacgggcaagcacgggaaggagatcaaggtgaccccgcagagctccatcaccgaggccgagctgaccggctacgggaccgtcacgatggagtgcagcccccggaccggcctcgacttcaacgagatggtgctgctgcagatggagaacaaggcgtggctcgtgcaccgccagtggttcctggacctgcccctcccctggctgccgggcgccgacatccaggggtccaactggatccagaaggagaccctggtcaccttcaagaacccccacgccaagaagcaggacgtggtcgtgctcggcagccaggagggggccatgcacacggccctgaccggcgcgaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtggtgcgggtccagtacgagggggacggcagcccctgcaagatccccttcgagatcatggacctggagaagcgccacgtgctcggccggctgatcaccgtgaacccgatcgtcacggagaaggactcccccgtgaacatcgaggccgagccgcccttcggggacagctacatcatcatcggcgtggagccggggcagctgaagctctcctggttcaagaagggcagctccatcgggcagatgttcgagaccaccatgcgcggcgccaagcgcatggccatcctgggcgacaccgcgtgggacttcgggagcctgggcggggtcttcacgtccatcggcaaggccctccaccaggtgttcggggccatctacggcgccgcgttcagcggcgtgtcctggaccatgaagatcctgatcggggtcgtgatcacctggatcggcatgaacagccggtccaccagcctgtccgtgagcctggtcctcgtgggggtggtcacgctgtacctgggcgtgatggtgcaggccgactccgggtgcgtcgtgagctggaagaacaaggagctcaagtgcggcagcggcatcttcatcaccgacaacgtgcacacctggaccgagcagtacaagttccagcccgagtcccccagcaagctggcctccgccatccagaaggcccacgaggaggggatctgcggcatccgcagcgtcacgcggctggagaacctcatgtggaagcagatcacccccgagctgaaccacatcctgtccgagaacgaggtgaagctcagcatcatgaccggggacatcaagggcatcatgcaggcggggaagcgctccctgcggccgcagcccaccgagctgaagtacagctggaagacgtggggcaaggccaagatgctctccaccgagccccacaaccagaccttcctgatcgacggcccggagaccgccgagtgccccaacacgaaccgcgcctggaacagcctggaggtggaggactacgggttcggcgtcttcaccaccaacatctggctcaagctgaaggagcggcaggacgtgttctgcgactccaagctgatgagcgccgcgatcaaggacaaccgcgccgtgcacgccgacatggggtactggatcgagtccgccctcaacgacacctggaagatcgagaaggccagcttcatcgaggtcaagtcctgccactggcccaagagccacacgctgtggtccaacggcgtgctggagagcgagatgatcatccccaagaacttcgcgggcccggtgagccagcacaactaccggcccgggtaccacacccagaccgccggcccctggcacctcgggaagctggagatggacttcgacttctgcgagggcaccaccgtcgtggtgacggaggactgcgggaaccgcggcccctccctgcggaccaccaccgccagcggcaagctcatcacggagtggtgctgccgctcctgcaccctgccgcccctgcggtaccgcggggaggacggctgctggtacgggatggagatccggcccctcaaggagaaggaggagaacctggtcaacagcctggtgaccgccggccacgggcagatcgacaacttctccctcggcgtgctgggcatggcgctgttcctcgaggagatgctgcgcacccgggtcgggacgaagcacgccgtgctgctcgtggccgtcagcttcatgaccctgatcaccggcaacatgtccttccgcgacctggggcgggtgatggtgatggtcggcgccgccatgaccgacgacatcgggatgggcgtgacgtacctcgcgctgctggccgccttcaaggtgcgccccaccttcgccgccggcctcctgctgcgcaagctcaccagcaaggagctgatgatgaccacgatcgggatcgtcctgctctcccagagcaccatcccggagaccatcctggagctgaccgacgcgctcgccctgggcatgatgatcctgaagatcgtgcggaacatggagaagtaccagctcgccgtcacgatcatggccatcctgtgcgtgcccaacgccgtgatcctgcagaacgcgtggaaggtctcctgcaccatcctcgccgccgtgagcgtgagccccctgctgctcaccagctcccagcagaaggccgactggatccccctggcgctgaccatcaaggggctcaacccgacggccatcttcctgaccaccctgagccgcaccaacaagaagcggtcctggcccctcaacgaggccatcatggccgtcggcatggtgagcatcctggcctccagcctgctcaagaacgacatccccatgacgggccccctggtggccggcgggctgctcaccgtctgctacgtgctgaccgggcgcagcgccgacctggagctcgagcgggccgccgacgtgcgctgggaggaccaggccgagatctccgggagctccccgatcctgagcatcaccatctccgaggacgggagcatgtccatcaagaacgaggaggaggagcagacgctgaccatcctcatccggaccggcctgctggtcatcagcggcctcttccccgtgtccatccccatcaccgcggccgcctggtacctgtgggaggtgaagaagcagcgcgccggggtcctgtgggacgtgcccagcccgccgcccgtgggcaaggccgagctcgaggacggggcgtaccggatcaagcagaagggcatcctggggtactcccagatcggcgccggcgtctacaaggaggggacgttccacaccatgtggcacgtgacccgcggcgccgtgctgatgcacaaggggaagcggatcgagccgagctgggccgacgtccgcaaggacctcatctcctacggcgggggctggaagctggagggcgagtggaaggagggggaggaggtccaggtgctggccctcgagcccggcaagaacccccgggcggtccagaccaagcccgggctgttcaagaccaacacgggcaccatcggggccgtgagcctggacttctccccgggcaccagcggctcccccatcgtggacaagaaggggaaggtcgtgggcctctacgggaacggcgtggtcacccgcagcggcacgtacgtgtccgccatcgcccagaccgagaagtccatcgaggacaaccccgagatcgaggacgacatcttccggaagaagcgcctgaccatcatggacctgcaccccggggcgggcaagaccaagcggtacctgccggccatcgtgcgcgaggccatcaagcgggggctccgcacgctgatcctggcccccacccgggtcgtggccgcggagatggaggaggccctccgcggcctgcccatccgctaccagacccccgccatccgggccgagcacaccgggcgcgagatcgtggacctgatgtgccacgccacgttcaccatgcggctcctgagcccggtccgcgtgcccaactacaacctgatcatcatggacgaggcgcacttcaccgaccccgcctccatcgccgcccggggctacatcagcacccgcgtggagatgggcgaggccgcggggatcttcatgacggccacgccgcccggctcccgggaccccttcccccagagcaacgcccccatcatggacgaggagcgcgagatccccgagcggtcctggaacagcgggcacgagtgggtcaccgacttcaagggcaagaccgtgtggttcgtgccctccatcaaggccgggaacgacatcgcggcctgcctccgcaagaacggcaagaaggtcatccagctgagccggaagacgttcgactccgagtacatcaagacccgcaccaacgactgggacttcgtggtgaccacggacatcagcgagatgggcgccaacttcaaggccgagcgggtcatcgacccccgccggtgcatgaagcccgtgatcctgaccgacggggaggagcgcgtgatcctcgccggcccgatgcccgtcacccactccagcgcggcccagcggcgcgggcggatcggccgcaaccccaagaacgagaacgaccagtacatctacatgggggagcccctggagaacgacgaggactgcgcccactggaaggaggccaagatgctgctcgacaacatcaacaccccggagggcatcatcccctccatgttcgagcccgagcgcgagaaggtggacgccatcgacggcgagtaccggctgcgcggggaggcgcggaagacgttcgtggacctgatgcgccggggcgacctcccggtctggctggcctaccgcgtggccgccgaggggatcaactacgccgaccggcgctggtgcttcgacggcatcaagaacaaccagatcctggaggagaacgtcgaggtggagatctggaccaaggagggggagcggaagaagctcaagccccgctggctggacgcgcggatctacagcgaccccctggccctcaaggagttcaaggagttcgccgccggccgcaagtccctgaccctgaacctcatcaccgagatgggccggctgcccacgttcatgacccagaaggcgcgcaacgccctggacaacctcgccgtgctgcacaccgccgaggccgggggccgggcgtacaaccacgccctgagcgagctcccggagaccctggagacgctgctcctgctgaccctcctggccaccgtcaccgggggcatcttcctgttcctcatgtccggcaaggggatcggcaagatgacgctggggatgtgctgcatcatcaccgccagcatcctgctctggtacgcccagatccagccccactggatcgcggcctccatcatcctggagttcttcctgatcgtgctcctgatccccgagcccgagaagcagcgcaccccgcaggacaaccagctgacctacgtggtcatcgccatcctcaccgtggtggccgccacgatggcgaacgagatgggcttcctggagaagaccaagaaggacttcgggctgggcagcatcgccacccagcagcccgagagcaacatcctcgacatcgacctgcggcccgcctccgcctggaccctgtacgccgtcgcgacgaccttcatcacccccatgctccgccacagcatcgagaactccagcgtgaacgtgtccctgaccgccatcgccaaccaggccacggtcctgatgggcctcgggaagggctggccgctgagcaagatggacatcggggtgcccctgctcgcgatcggctgctactcccaggtgaaccccatcaccctgaccgccgccctgctcctgctggtcgcccactacgccatcatcgggcccggcctccaggcgaaggccacccgggaggcccagaagcgcgccgccgcgggcatcatgaagaacccgacggtggacgggatcaccgtgatcgacctggaccccatcccctacgaccccaagttcgagaagcagctgggccaggtcatgctcctggtgctgtgcgtgacccaggtcctcatgatgcggaccacgtgggccctgtgcgaggccctgaccctcgccaccgggccgatcagcaccctgtgggagggcaaccccgggcgcttctggaacacgaccatcgccgtgtccatggcgaacatcttccgcggcagctacctggccggcgccgggctcctgttctccatcatgaagaacaccaccaacacgcggcgcggcaccgggaacaccggcgagaccctgggcgagaagtggaagaaccggctcaacagcctggggaagtccgagttccagatctacaagcgcagcggcatccaggaggtggaccggacgctggccaaggaggggatcaagcgcggcgagaccgaccaccacgcggtctcccgggggagcgccaagctccgctggttcgtggagcggaacctggtgacccccgagggcaaggtcgtggacctgggctgcgggcgcggcgggtggtcctactactgcggcgggctcaagaacgtgcgggaggtcaagggcctgaccaagggcgggcccggccacgaggagccgatccccatgagcacgtacgggtggaacctggtgcgcctccagtccggcgtggacgtcttcttcacgccgcccgagaagtgcgacaccctgctgtgcgacatcggggagagcagcccgaaccccaccgtggaggccggccggacgctccgcgtgctgaacctggtcgagaactggctcaacaacaacacccagttctgcatcaaggtgctgaacccctacatgccgtccgtgatcgagaagatggagaccctgcagcggaagtacggcggggccctggtccgcaaccccctcagccggaactccacccacgagatgtactgggtgagcaacgcctccggcaacatcgtgagctccgtcaacatgatcagccgcatgctgatcaaccggttcaccatgcgccacaagaaggcgacgtacgagcccgacgtggacctggggtccggcacccgcaacatcgggatcgagagcgagacccccaacctcgacatcatcggcaagcggatcgagaagatcaagcaggagcacgagacctcctggcactacgaccaggaccacccgtacaagacgtgggcctaccacggcagctacgagaccaagcagaccgggtccgccagctccatggtgaacggcgtcgtgcgcctgctgaccaagccctgggacgtgatccccatggtcacgcagatggccatgaccgacaccacccccttcgggcagcagcgggtgttcaaggagaaggtggacacgcgcacccaggagccgaaggagggcaccaagaagctcatgaagatcaccgccgagtggctgtggaaggagctgcggaagaagaagacgccccgcatgtgcacccgggaggagttcgcgcgcaaggtccggagcaacgccgccctcggcgccatcttcaccgacgagaacaagtggaagtccgcccgcgaggcggtggaggacagccggttctgggagctggtcgacaaggagcgcaacctgcacctcgaggggaagtgcgagacctgcgtgtacaacatgatgggcaagcgggagaagaagatcggggagttcggcaaggccaaggggtcccgcgccatctggtacatgtggctgggcgcccggttcctggagttcgaggcgctcggcttcctgaacgaggaccactggttcagccgcgagaacagcctgtccggggtggagggcgaggggctccacaagctgggctacatcctgcgggaggtcagcaagaaggagggcggcgccatgtacgccgacgacacggccggctgggacacccgcatcaccctcgaggacctgaagaacgaggagatggtgaccaaccacatggagggggagcacaagaagctggccgaggcgatcttcaagctcacgtaccagaacaaggtggtccgggtgcagcgccccacgccccggggcaccgtgatggacatcatctcccgccgcgaccagcgggggagcggccaggtcgggacctacggcctgaacacgttcaccaacatgggcgcccagctgatccgccagatggagggggagggcgtgttcaaggggatccagcacctcaccgccaccgaggaggtggccgtccaggactggctggcccgggtgggccgcgagcggctgtcccgcatggcgatcagcggcgacgactgcgtggtcaagccgctcgacgaccggttcgcctccgccctgacggccctgaacgacatggggaaggtgcgcaaggacatccagcagtgggagcccagccggggctggaacgactggacccaggtgcccttctgctcccaccacttccacgagctcatcatgaaggacgggcgcgtcctggtggtgccctgccggaaccaggacgagctgatcggccgcgcccggatcagccagggggcgggctggtccctccgcgagaccgcctgcctgggcaagagctacgcccagatgtggtccctgatgtacttccaccggcgcgacctccggctggccgccaacgcgatctgcagcgccgtcccgtcccactgggtgcccaccagccgcacgacctggtccatccacgcccggcacgagtggatgaccaccgaggacatgctgaccgtgtggaaccgcgtctggatccaggagaacccctggatggaggacaagacgcccgtggagagctgggaggagatcccgtacctcgggaagcgcgaggaccagtggtgcggcagcctgatcgggctgacctcccgggccacctgggcgaagaacatccagaccgccatcaaccaggtgcgcagcctcatcggctccgaggagtacacggactacatgcccagcatgaagcggttccgccgggaggaggaggaggccggggtcctgtggtga

SEQ ID NO: 9186 - RNA, 9876 nt, synthetic construct
  misc_feature 1..9876: note = derived and/or modified CDS sequence (opt1) from DENV-2__FJ898438__SS-prME
  source 1..9876: mol_type = other RNA
accgtgggcgtcatcgtgatgctgatccccaccgccatggccttccacctcaccacccgcaacggggagccgcacatgatcgtgggccggcaggagaagggcaagagcctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctgggtgacctacgggacctgctccaccaccggcgagcaccggcgcgagaagcggagcgtggccctggtcccccacgtggggatgggcctcgagacccgcaccgagacctggatgtccagcgagggggcctggaagcacgtgcagcggatcgagacctggatcctgcgccacccgggcttcacgatcatggccgccatcctggcgtacaccatcgggaccacccacttccagcgggccctcatcttcatcctgctgacggccgtcgccccctccatgaccatgcgctgcatcggcatcagcaaccgggacttcgtggagggcgtgtccgggggcagctgggtcgacatcgtgctcgagcacgggtcctgcgtgaccaccatggcgaagaacaagcccacgctggacttcgagctgatcaagaccgaggccaagcagcccgccaccctccgcaagtactgcatcgaggccaagctgaccaacacgaccaccgagagccggtgcccgacccagggcgagccctccctgaacgaggagcaggacaagcgcttcatctgcaagcacagcatggtcgaccggggctgggggaacggctgcgggctgttcggcaagggcgggatcgtgacgtgcgccatgttcacgtgcaagaagaacatggagggcaaggtggtccagcccgagaacttcgagtacaccatcgtgatcacgccccactccggggaggagcacgcggtgggcaacgacacggggaagcacggcaaggagatcaagatcaccccgcagagctccatcaccgaggccgagctgaccgggtacggcaccgtcacgatggagtgcagcccccgcaccggcctggacttcaacgagatggtgctcctgcagatggaggacaaggcctggctggtgcaccggcagtggttcctcgacctgcccctgccctggctcccgggggccgacacccagggctccaactggatccagaaggagaccctggtcacgttcaagaacccccacgccaagaagcaggacgtggtcgtgctggggagccaggagggcgcgatgcacaccgccctcaccggggccaccgagatccagatgagctccggcaacctgctgttcacgggccacctcaagtgccgcctgcggatggacaagctgcagctcaaggggatgagctactccatgtgcaccggcaagttcaagatcgtgaaggagatcgccgagacccagcacgggaccatcgtcatccgcgtgcagtacgagggcgacggcagcccctgcaagatccccttcgagatcacggacctggagaagcggcacgtgctggggcgcctcatcaccgtcaacccgatcgtgaccgagaaggactcccccgtgaacatcgaggccgagccgcccttcggcgacagctacatcatcatcggggtcgagccgggccagctgaagctgaactggttcaagaaggggtccagcatcggccagatgttcgagaccacgatgcgcggcgcgaagcggatggccatcctcggggacaccgcctgggacttcggctccctcggcggggtgttcaccagcatcgggaaggccctgcaccaggtgttcggggccatctacggcgcggccttctccggggtcagctggaccatgaagatcctcatcggcgtgatcatcacgtggatcgggatgaactcccgcagcacctccctgagcgtgtccctggtcctggtgggcgtggtcaccctctacctgggggccatggtgcaggccgacagcggctgcgtggtctcctggaagaacaaggagctgaagtgcggcagcgggatcttcatcaccgacaacgtgcacacgtggaccgagcagtacaagttccagcccgagagcccctccaagctcgcgagcgccatccagaaggcccacgaggagggcatctgcgggatccggtccgtgacccgcctggagaacctgatgtggaagcagatcacccccgagctcaaccacatcctgagcgagaacgaggtcaagctgacgatcatgaccggcgacatcaaggggatcatgcaggccggcaagcggtccctccgcccgcagcccaccgagctgaagtacagctggaagacctggggcaaggccaagatgctgtccacggagagccacaaccagaccttcctcatcgacgggcccgagaccgcggagtgcccgaactccaaccgggcctggaacagcctggaggtggaggactacggcttcggggtgttcaccacgaacatctggctgaagctccgcgagaagcaggacgtcttctgcgactccaagctgatgagcgccgccatcaaggacaaccgggccgtgcacgcggacatgggctactggatcgagtccgccctgaacgacacctggaagatggagaaggccagcttcatcgaggtgaagtcctgccactggcccaagagccacaccctctggtccaacggcgtcctggagagcgagatgatcatccccaagaacttcgccgggcccgtgagccagcacaactaccgcccgggctaccacacccagaccgccgggccctggcacctgggcaagctcgagatggacttcgacttctgcgaggggacgaccgtggtcgtgaccgaggactgcggcaaccggggcccctccctgcgcaccacgaccgcgagcgggaagctgatcaccgagtggtgctgccggtcctgcaccctcccgcccctgcgctaccggggcgaggacgggtgctggtacggcatggagatccgccccctgaaggagaaggaggagaacctcgtgaacagcctggtcacggccgggcacggccagatcgacaacttctccctgggcgtgctcgggatggccctgttcctggaggagatgctccggacccgcatcggcaccaagcacgccatcctgctggtggcggccagcttcgtcaccctcatcacggggaacatgtccttccgggacctgggccgcgtgatggtgatggtcggggccaccatgaccgacgacatcggcatgggcgtgacctacctggccctcctggccgcgttcaaggtgcgccccacgttcgccgccgggctgctcctgcggaagctgaccagcaaggagctcatgatggccaccatcggcatcgccctgctgtcccagagcaccatccccgagacgatcctcgagctgaccgacgcgctggccctcgggatgatggtcctgaagatcgtgcgcaacatggagaagtaccagctggccgtgaccatcatggccatctcctgcgtccccaacgccgtgatcctccagaacgcgtggaaggtgagctgcaccatcctggccgccgtctccgtgagccccctgctcctgacgtccagccagcagaaggccgactggatccccctggcgctcaccatcaagggcctgaaccccaccgccatcttcctgaccacgctctcccggaccagcaagaagcgctcctggccgctgaacgaggccgtcatggccgtgggcatggtgagcatcctggccagctccctcctgaagaacgacatccccatgaccgggcccctggtcgcgggcgggctcctgaccgtgtgctacgtgctgacgggccggagcgccgacctcgagctggagcgcgccgccgacgtcaagtgggaggaccaggccgagatctccgggagctcccccatcctgagcatcaccatctccgaggacggcagcatgtccatcaagaacgaggaggaggagcagaccctcaccatcctgatccggacgggcctgctcgtgatcagcggggtgttcccggtctccatccccatcaccgcggccgcctggtacctgtgggaggtgaagaagcagcgcgccggcgtgctgtgggacgtcccctccccgccgcccgtggggaaggccgagctcgaggacggcgcgtaccggatcaagcagcgcgggatcctgggctactcccagatcggcgccggggtgtacaaggagggcaccttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggccctcgagcccgggaagaacccccgcgcggtgcagacgaagcccggcatcttcaagaccaacaccgggaccatcggcgccgtcagcctggacttctcccccggcacgagcgggtcccccatcgtggaccggaagggcaaggtggtcgggctgtacggcaacggcgtggtgacccgcagcggggcctacgtcagcgccatcgcgcagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctccgcaccctgatcctggccccgacccgcgtggtcgcggccgagatggaggaggccctgcgggggctccccatccgctaccagacccccgccatcaagacggagcacaccggccgggagatcgtggacctgatgtgccacgccaccttcaccatgcgcctgctcagccccgtgcgggtcccgaactacaacctgatcatcatggacgaggcgcacttcacggaccccgcctccatcgccgcccgcggctacatcagcacccgggtggagatgggggaggccgcgggcatcttcatgaccgccacgccgcccgggtcccgcgacccgttcccccagagcaacgcccccatcatggacgaggagcgggagatccccgagcgctcctggaacagcggccacgagtgggtgacggacttcaaggggaagaccgtctggttcgtgccgtccatcaaggccggcaacgacatcgcggcctgcctgcggaagaacggcaagaaggtgatccagctcagccgcaagaccttcgactccgagtacgtcaagacccgggccaacgactgggacttcgtggtgacgaccgacatcagcgagatgggggccaacttcaaggccgagcgcgtcatcgacccccggcgctgcatgaagcccgtgatcctgaccgacggcgaggagcgggtgatcctggcggggcccatgccggtcacccactccagcgccgcccagcgccggggccgcatcgggcgcaaccccaagaacgagaacgaccagtacatctacatgggcgagcccctcgagaacgacgaggactgcgcccactggaaggaggccaagatgctgctggacaacatcaacacgcccgagggcatcatcccgtccatgttcgagcccgagcgggagaaggtggacgcgatcgacggggagtaccgcctccggggcgaggcccgcaagaccttcgtggacctgatgcggcgcggggacctgcccgtctggctcgcctacaaggtggccgccgagggcatcaactacgcggaccggaagtggtgcttcgacgggatcaagaacaaccagatcctggaggagaacatggaggtggagatctggaccaaggagggcgagcgcaagaagctgaagccgcggtggctcgacgcccgcatctacagcgaccccctggccctgaaggagttcaaggagttcgccgcgggccggaagtccctcaccctgaacctgatcacggagatggggcgcctccccaccttcatgacccagaaggcccggaacgccctggacaacctggccgtcctccacaccgccgaggcgggcgggcgcgcctacaaccacgccctgagcgagctgcccgagacgctcgagaccctgctgctcctgaccctgctcgccaccgtgacgggcggcatcttcctgttcctgatgtccgggaagggcatcgggaagatgaccctcggcatgtgctgcatcatcaccgccagcatcctgctgtggtacgcgcagatccagccgcactggatcgccgccagcatcatcctcgagttcttcctgatcgtcctgctcatccccgagcccgagaagcagcggacgccccaggacaaccagctgacctacgtggtgatcgccatcctgacggtcgtggccgcgaccatggccaacgagatggggttcctcgagaagaccaagaaggacctgggcctgggctccatcaccacgcaggagagcgagtccaacatcctcgacatcgacctgcgcccggccagcgcctggaccctgtacgccgtggcgaccaccttcgtcacgcccatgctccggcactccatcgagaacagctccgtgaacgtgagcctgaccgccatcgccaaccaggccaccgtcctgatggggctcggcaaggggtggcccctgtccaagatggacatcggcgtgcccctgctcgcgatcgggtgctacagccaggtgaacccgatcaccctgacggccgccctgctcctgctggtcgcccactacgccatcatcggccccggcctccaggcgaaggccacccgcgaggcccagaagcgggccgccgcggggatcatgaagaaccccaccgtggacggcatcaccgtgatcgacctggagcccatcccgtacgaccccaagttcgagaagcagctggggcaggtcatgctcctgatcctgtgcgtgacccaggtgctcatgatgcgcaccacctgggccctgtgcgaggccctgaccctcgccacgggccccatctccaccctgtgggaggggaaccccggccggttctggaacaccaccatcgccgtcagcatggcgaacatcttccgcggctcctacctggccggggccggcctcctgttcagcatcatgaagaacacgaccaacacccgccgggggaccggcaacatcggcgagacgctgggggagaagtggaagtcccgcctcaacgccctgggcaagagcgagttccagatctacaagaagtccgggatccaggaggtggaccggaccctggcgaaggagggcatcaagcgcggggagaccgaccaccacgccgtgagccggggctccgccaagctccgctggttcgtcgagcggaacatggtgaccccggagggcaaggtggtcgacctggggtgcggccgcgggggctggagctactactgcgggggcctgaagaacgtgcgggaggtgaagggcctcacgaagggcgggcccgggcacgaggagcccatccccatgagcacctacggctggaacctggtccgcctgcagtccggggtggacgtgttcttcaccccgcccgagaagtgcgacaccctcctgtgcgacatcggcgagagctcccccaaccccacgatcgaggccggccggaccctgcgcgtcctcaacctggtggagaactggctgaacaacaacacccagttctgcatcaaggtgctcaacccgtacatgcccagcgtcatcgagaagatggagaccctgcagcggaagtacgggggcgccctggtgcgcaaccccctctcccggaacagcacccacgagatgtactgggtgtccaacgcgacggggaacatcgtcagctccgtgaacatgatcagccgcatgctgatcaaccggttcaccatgaagcacaagaaggccacctacgagccggacgtggacctgggctccgggacccgcaacatcggcatcgagagcgagatccccaacctggacatcatcggcaagcggatcgagaagatcaagcaggagcacgagacgtcctggcactacgaccaggaccacccctacaagacctgggcctaccacgggagctacgagaccaagcagaccggctccgccagctccatggtcaacggggtggtgcgcctcctgacgaagccctgggacgtcgtgccgatggtgacccagatggccatgaccgacaccacgcccttcggccagcagcgcgtcttcaaggagaaggtggacacccggacccaggagcccaaggagggcaccaagaagctgatgaagatcacggcggagtggctctggaaggagctggggaagaagaagacgccccggatgtgcacccgggaggagttcacccgcaaggtgcggagcaacgccgccctgggcgccatcttcacggacgagaacaagtggaagtccgcccgcgaggcggtcgaggacgggcggttctgggagctcgtggaccgcgagcggaacctgcacctggagggcaagtgcgagacctgcgtgtacaacatgatggggaagcgcgagaagaagctcggcgagttcggcaaggccaaggggagccgggccatctggtacatgtggctgggcgcccgcttcctggagttcgaggcgctcgggttcctgaacgaggaccactggttcagccggggcaactccctgagcggggtcgagggcgagggcctccaccgcctggggtacatcctgcgggacgtgggcaagaaggagggcggcgccatgtacgccgacgacaccgccgggtgggacacccgcatcacgctcgaggacctgaagaacgaggagatggtcaccaaccacatgaagggcgagcacaagaagctggccgaggcgatcttcaagctcacctaccagaacaaggtggtgcgggtccagcgcccgacgccccggggcaccgtgatggacatcatctcccgccgggaccagcgcgggagcggccaggtggggacctacggcctgaacaccttcaccaacatggaggcccagctgatccgccagatggagggcgaggggatcttcaagtccatccagcacctcacggccaccgaggagatcgccgtccagaactggctggcccgggtgggccgcgagcggctgagccgcatggcgatctccggggacgactgcgtggtcaagcccatcgacgaccggttcgccagcgccctcaccgccctgaacgacatgggcaaggtgcgcaaggacatccagcagtgggagccctcccgggggtggaacgactggacccaggtgccgttctgcagccaccacttccacgagctggtcatgaaggacggccgcgtgctcgtggtcccctgccggaaccaggacgagctgatcggccgcgcccggatctcccagggggcgggctggagcctgaaggagacggcctgcctcgggaagtcctacgcccagatgtggaccctgatgtacttccaccgccgggacctgcgcctcgccgccaacgcgatctgcagcgccgtgccctcccactgggtgcccaccagccggaccacctggtccatccacgccaagcacgagtggatgacgaccgaggacatgctggccgtctggaaccgcgtgtggatccaggagaacccgtggatggaggacaagacccccgtggagagctgggaggaggtcccctacctgggcaagcgggaggaccagtggtgcgggagcctcatcggcctgacctcccgcgcgacgtgggccaagaacatccagaccgccatcaaccaggtgcggagcctgatcggcaacgaggagtacaccgactacatgccctccatgaagcgcttccgccgggaggaggaggaggccggggtgctctggtga

SEQ ID NO: 9187 - RNA, 9876 nt, synthetic construct
  misc_feature 1..9876: note = derived and/or modified CDS sequence (opt1) from DENV-2__GQ199893__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagaaggccctcatcttcatcctgctgaccgccgtggcgcccagcatgaccatgcggtgcatcggcatctccaaccgcgacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccggaagtactgcatcgaggccaagctgacgaacaccaccaccgagtcccgctgccccacgcagggcgagcccagcctgaacgaggagcaggacaagcggttcatctgcaagcactccatggtggaccgcggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccgccagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcgcatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccggtccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgggtgatggtgatggtcggggccaccatgacggacgacatcggcatgggcgtgacctacctggccctgctcgccgcgttcaaggtgcgccccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcggaccctgatcctcgccccgacgcgcgtggtggcggccgagatggaggaggccctgcgcggcctgcccatccggtaccagacccccgccatcaagaccgagcacaccgggcgcgagatcgtcgacctcatgtgccacgccacgttcaccatgcggctgctgagccccgtgcgcgtgccgaactacaacctcatcatcatggacgaggcgcacttcaccgaccccgcctccatcgccgcccggggctacatcagcacccgcgtcgagatgggcgaggccgcggggatcttcatgacggccacgccgcccggctcccgggacccgttcccccagagcaacgcccccatcatggacgaggagcgcgagatccccgagcggtcctggaacagcgggcacgagtgggtgaccgacttcaagggcaagaccgtgtggttcgtcccgtccatcaaggccgggaacgacatcgcggcctgcctgcgcaagaacggcaagaaggtgatccagctgagccggaagacgttcgactccgagtacgtgaagacccgcgccaacgactgggacttcgtcgtgaccaccgacatcagcgagatgggcgccaacttcaaggccgagcgggtgatcgacccccgccggtgcatgaagcccgtcatcctcacggacggggaggagcgcgtgatcctggcgggccccatgccggtgacccactccagcgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtcgacgcgatcgacggcgagtaccggctgcgcggggaggcccggaagaccttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatcgaggtggagatctggacgaaggagggggagcggaagaagctgaagccgcgctggctggacgcccggatctacagcgaccccctcgccctgaaggagttcaaggagttcgccgcgggccgcaagtccctgaccctcaacctgatcaccgagatgggccggctgcccaccttcatgacgcagaaggcccgcaacgccctcgacaacctggccgtgctgcacaccgccgaggccgggggccgggcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcgcacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccggccggccagcgcctggaccctgtacgccgtggcgacgaccttcgtgacccccatgctgcgccactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacccgggaggcccagaagcgcgccgccgcgggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaaccccgggcgcttctggaacacgaccatcgccgtgagcatggcgaacatcttccggggctcctacctggccggcgccgggctcctgttcagcatcatgaagaacaccaccaacacgcgccgcggcaccgggaacatcggcgagaccctgggcgagaagtggaagtcccggctgaacgccctcggcaagagcgagttccaggtctacaagaagtccggcatccaggaggtggaccgcaccctggcgaaggaggggatcaagcggggcgagacggaccaccacgccgtgagccgcgggtccgccaagctgcggtggttcgtcgagcgcaacatggtgaccccggagggcaaggtggtcgacctcggctgcgggcggggcgggtggagctactactgcggcgggctgaagaacgtgcgcgaggtgaagggcctgaccaagggcgggcccggccacgaggagcccatccccatgtccacctacgggtggaacctcgtccggctgcagagcggcgtggacgtgttcttcacgccgcccgagaagtgcgacaccctgctctgcgacatcggggagagctcccccaaccccaccatcgaggccggccgcaccctgcgggtcctgaacctcgtggagaactggctgaacaacaacacccagttctgcatcaaggtgctgaacccgtacatgcccagcgtcatcgagaagatggaggccctccagcgcaagtacggcggggcgctggtgcggaaccccctgtcccgcaacagcacgcacgagatgtactgggtgtccaacgccaccggcaacatcgtcagctccgtgaacatgatcagccggatgctgatcaaccgcttcaccatgaagcacaagaaggccacctacgagccggacgtggacctcgggtccggcacgcggaacatcgggatcgagagcgagatccccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtcaacggcgtggtgcggctgctcaccaagccctgggacgtcgtgccgatggtgacccagatggcgatgaccgacacgacccccttcgggcagcagcgcgtcttcaaggagaaggtggacacccgcacccaggagcccaaggagggcacgaagaagctgatgaagatcaccgccgagtggctgtggaaggagctcggcaagaagaagacgccccggatgtgcacccgcgaggagttcacgcggaaggtgcgcagcaacgccgccctgggggccatcttcaccgacgagaacaagtggaagtccgcgcgggaggccgtcgaggacggccgcttctgggagctggtggaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtcgagggggagggcctgcaccggctcggctacatcctgcgcgacgtggggaagaaggagggcggggccatgtacgccgacgacaccgccggctgggacacgcggatcaccctggaggacctcaagaacgaggagatggtcaccaaccacatgaagggggagcacaagaagctggcggaggccatcttcaagctgacctaccagaacaaggtggtgcgcgtccagcggccgacgccccgcggcaccgtgatggacatcatctcccggcgcgaccagcggggcagcgggcaggtcggcacctacgggctcaacaccttcacgaacatggaggcccagctgatccgccagatggagggcgagggcatcttcaagtccatccagcacctgaccgccaccgaggagatcgccgtccagaactggctcgcgcgcgtggggcgggagcgcctgagccggatggccatctccggcgacgactgcgtggtcaagcccatcgacgaccgcttcgccagcgccctgaccgccctcaacgacatggggaaggtgcggaaggacatccagcagtgggagccctcccgcggctggaacgactggacccaggtgccgttctgcagccaccacttccacgagctggtcatgaaggacgggcgggtgctggtggtcccctgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtgccgccccactgggtgccgacctcccgcaccacgtggagcatccacgccaagcacgagtggatgaccaccgaggacatgctcgcggtctggaaccgggtgtggatccaggagaacccctggatggaggacaagacccccgtggagtcctgggaggaggtcccctacctggggaagcgcgaggaccagtggtgcggcagcctgatcgggctcacgtcccgggccacctgggccaagaacatccagaccgccatcaaccaggtgcgcagcctgatcggcaacgaggagtacaccgactacatgccgagcatgaagcggttccgccgcgaggaggaggaggccggcgtgctgtggtga

SEQ ID NO: 9188 - RNA, 9876 nt, synthetic construct
  misc_feature 1..9876: note = derived and/or modified CDS sequence (opt1) from DENV-2__GQ199894__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagaaggccctcatcttcatcctgctgaccgccgtggcgcccagcatgaccatgcggtgcatcggcatctccaaccgcgacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccggaagtactgcatcgaggccaagctgacgaacaccaccaccgagtcccgctgccccacgcagggcgagcccagcctgaacgaggagcaggacaagcggttcatctgcaagcactccatggtggaccgcggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccgccagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcgcatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccggtccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagcacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgccagcttcgtgaccctgatcaccgggaacatgtccttccgcgacctcggccgggtcatggtgatggtgggggccaccatgacggacgacatcggcatgggcgtcacctacctggccctgctcgcggccttcaaggtgcgccccaccttcgccgccgggctgctgctccgcaagctgaccagcaaggagctgatgatggccacgatcggcatcgcgctcctgtcccagagcaccatccccgagaccatcctggagctcaccgacgccctggccctggggatgatggtgctcaagatcgtccggaacatggagaagtaccagctggccgtgacgatcatggccatctcctgcgtgccgaacgcggtcatcctgcagaacgcctggaaggtgagctgcaccatcctcgccgccgtgtccgtcagccccctgctgctcacctccagccagcagaaggcggactggatccccctggccctgaccatcaagggcctcaaccccacggccatcttcctgaccaccctgtcccgcaccagcaagaagcggtcctggccgctcaacgaggccatcatggccgtgggcatggtcagcatcctggcgtccagcctgctcaagaacgacatccccatgacggggcccctggtggccggcgggctgctcaccgtgtgctacgtcctgaccggccgcagcgccgacctggagctcgagcgggccgccgacgtgaagtgggaggaccaggcggagatctccgggagctcccccatcctgagcatcaccatctccgaggacggcagcatgtccatcaagaacgaggaggaggagcagacgctgaccatcctcatccgcaccggcctgctggtgatcagcggggtcttcccggtgtccatccccatcaccgccgccgcctggtacctctgggaggtgaagaagcagcgggccggcgtcctgtgggacgtgcccagcccgccgcccgtggagaaggcggagctggaggacggggcctaccgcatcaagcagcggggcatcctcgggtactcccagatcggcgccggcgtctacaaggaggggaccttccacacgatgtggcacgtgacccgcggcgccgtgctgatgcaccgggggaagcgcatcgagcccagctgggccgacgtcaagaaggacctgatctcctacggcgggggctggaagctcgagggcgagtggaaggagggggaggaggtccaggtcctggcgctggagcccggcaagaacccccgggccgtccagaccaagcccgggatcttcaagaccaacacgggcaccatcggggccgtgagcctcgacttctcccccggcaccagcggctcccccatcgtggaccgcaaggggaaggtcgtgggcctgtacgggaacggcgtggtcacccggagcggcgcctacgtgtccgcgatcgcccagacggagaagtccatcgaggacaaccccgagatcgaggacgacatcttccgcaagaagcggctgaccatcatggacctccaccccggggccggcaagaccaagcgctacctgcccgccatcgtgcgggaggccatcaagcgcgggctgcggaccctgatcctcgcgccgacgcgcgtcgtggccgccgagatggaggaggccctgcgcggcctgcccatccggtaccagacccccgccatcaagaccgagcacaccgggcgcgagatcgtggacctcatgtgccacgcgacgttcaccatgcggctgctgagccccgtccgcgtgccgaactacaacctcatcatcatggacgaggcccacttcaccgaccccgcctccatcgccgcccggggctacatcagcacccgcgtggagatgggcgaggcggccgggatcttcatgacggccacgccgcccggctcccgggacccgttcccccagagcaacgcccccatcatggacgaggagcgcgagatccccgagcggtcctggaacagcgggcacgagtgggtcaccgacttcaagggcaagaccgtgtggttcgtgccgtccatcaaggcggggaacgacatcgccgcctgcctgcgcaagaacggcaagaaggtcatccagctgagccggaagacgttcgactccgagtacgtgaagacccgcgccaacgactgggacttcgtggtcaccaccgacatcagcgagatgggcgccaacttcaaggcggagcgggtgatcgacccccgccggtgcatgaagcccgtgatcctcacggacggggaggagcgcgtcatcctggccggccccatgccggtgacccactccagcgccgcccagcggcgcgggcggatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgcgagaaggtggacgccatcgacggcgagtaccggctgcgcggggaggcccggaagaccttcgtcgacctcatgcgccggggcgacctgcccgtgtggctggcctacaaggtggccgcggaggggatcaactacgccgaccgcaagtggtgcttcgacggcatcaagaacaaccagatcctcgaggagaacatcgaggtcgagatctggacgaaggagggggagcggaagaagctgaagccgcgctggctggacgcccggatctacagcgaccccctcgccctgaaggagttcaaggagttcgcggccggccgcaagtccctgaccctcaacctgatcaccgagatgggccggctgcccaccttcatgacgcagaaggcccgcaacgccctcgacaacctggccgtgctgcacaccgcggaggccgggggccgggcctacaaccacgccctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgcgagcatcctcctgtggtacgcccagatccagccgcactggatcgccgcctccatcatcctggagttcttcctcatcgtcctgctgatccccgagcccgagaagcagcgcacgccccaggacaaccagctcacctacgtggtcatcgccatcctgaccgtggtggcggccaccatggccaacgagatgggcttcctggagaagacgaagaaggacctcgggctgggcagcatcaccacccaggagagcgagtccaacatcctggacatcgacctccggccggccagcgcctggaccctgtacgcggtcgccacgaccttcgtgacccccatgctgcgccactccatcgagaacagctccgtgaacgtcagcctcaccgccatcgccaaccaggcgacggtgctgatgggcctggggaagggctggcccctctccaagatggacatcggggtgcccctgctggccatcggctgctacagccaggtcaacccgatcaccctcaccgccgccctgctgctcctggtggcccactacgcgatcatcgggcccggcctgcaggccaaggccacccgggaggcccagaagcgcgccgcggccggcatcatgaagaaccccacggtggacgggatcaccgtcatcgacctcgagcccatcccgtacgaccccaagttcgagaagcagctgggccaggtgatgctgctcatcctgtgcgtgacccaggtcctgatgatgcggaccacgtgggccctctgcgaggccctgaccctggccaccgggcccatctccaccctctgggagggcaaccccgggcgcttctggaacacgaccatcgcggtgagcatggccaacatcttccggggctcctacctggccggcgccgggctcctgttcagcatcatgaagaacaccaccaacacgcgccgcggcaccgggaacatcggcgagaccctgggcgagaagtggaagtcccggctgaacgcgctcggcaagagcgagttccaggtgtacaagaagtccggcatccaggaggtcgaccgcaccctggccaaggaggggatcaagcggggcgagacggaccaccacgccgtgagccgcgggtccgccaagctgcggtggttcgtggagcgcaacatggtcaccccggagggcaaggtggtggacctcggctgcgggcggggcgggtggagctactactgcggcgggctgaagaacgtccgcgaggtgaagggcctgaccaagggcgggcccggccacgaggagcccatccccatgtccacctacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacccagttctgcatcaaggtgctgaacccgtacatgcccagcgtgatcgagaagatggaggcgctccagcgcaagtacggcggggccctggtccggaaccccctgtcccgcaacagcacgcacgagatgtactgggtgtccaacgccaccggcaacatcgtgagctccgtcaacatgatcagccggatgctgatcaaccgcttcaccatgaagcacaagaaggccacctacgagccggacgtggacctcgggtccggcacgcggaacatcgggatcgagagcgagatccccaacctggacatcatcggcaagcgcatcgagaagatcaagcaggagcacgagacctcctggcactacgaccaggaccacccctacaagacctgggcctaccacggcagctacgagaccaagcagacggggtccgcgagctccatggtgaacggcgtcgtgcggctgctcaccaagccctgggacgtggtcccgatggtgacccagatggccatgaccgacacgacccccttcgggcagcagcgcgtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgcagcaacgccgccctgggggcgatcttcaccgacgagaacaagtggaagtccgcccgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacaccgcgggctgggacacgcggatcaccctggaggacctcaagaacgaggagatggtgaccaaccacatgaagggggagcacaagaagctggccgaggccatcttcaagctgacctaccagaacaaggtcgtgcgcgtgcagcggccgacgccccgcggcaccgtcatggacatcatctcccggcgcgaccagcggggcagcggccaggtgggcacctacgggctcaacaccttcacgaacatggaggcccagctgatccgccagatggagggcgagggcatcttcaagtccatccagcacctgaccgccaccgaggagatcgcggtgcagaactggctcgcccgcgtcgggcgggagcgcctgagccggatggccatctccggcgacgactgcgtggtgaagcccatcgacgaccgcttcgccagcgccctgaccgcgctcaacgacatggggaaggtccggaaggacatccagcagtgggagccctcccgcggctggaacgactggacccaggtgccgttctgcagccaccacttccacgagctggtgatgaaggacgggcgggtcctggtggtgccctgccgcaaccaggacgagctcatcggccgggcccgcatctcccagggcgccgggtggagcctgaaggagaccgcctgcctgggcaagtcctacgcccagatgtggaccctcatgtacttccaccggcgcgacctgcggctggcggccaacgccatctgcagcgccgtgccgccccactgggtgccgacctcccgcaccacgtggagcatccacgcgaagcacgagtggatgaccaccgaggacatgctcgccgtgtggaaccgggtctggatccaggagaacccctggatggaggacaagacccccgtggagtcctgggaggaggtgccctacctggggaagcgcgaggaccagtggtgcggcagcctgatcgggctcacgtcccgggccacctgggccaagaacatccagaccgccatcaaccaggtccgcagcctgatcggcaacgaggagtacaccgactacatgccgagcatgaagcggttccgccgcgaggaggaggaggcgggcgtgctgtggtga

SEQ ID NO: 9189 - RNA, 9876 nt, synthetic construct
  misc_feature 1..9876: note = derived and/or modified CDS sequence (opt1) from DENV-2__FJ898439__SS-prME
  source 1..9876: mol_type = other RNA
accgccggggtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgctccaccaccggcgagcaccggcgcgagaagcggagcgtggccctggtgccccacgtcgggatgggcctcgagacccggaccgagacctggatgagcagcgagggggcctggaagcacgtgcagcggatcgagacctggatcctgcggcacccgggcttcacgatcatggccgcgatcctggcctacaccatcgggaccacccacttccagcgggccctcatcttcatcctgctgacggccgtggcgcccagcatgaccatgcgctgcatcggcatcagcaaccgggacttcgtcgagggcgtgtccgggggcagctgggtggacatcgtcctcgagcacgggtcctgcgtgaccaccatggccaagaacaagcccacgctggacttcgagctgatcaagaccgaggccaagcagcccgccaccctccgcaagtactgcatcgaggccaagctgaccaacacgaccaccgagagccggtgcccgacccagggcgagccctccctgaacgaggagcaggacaagcgcttcatctgcaagcacagcatggtggaccggggctgggggaacggctgcggcctgttcggcaagggcgggatcgtcacgtgcgcgatgttcacgtgcaagaagaacatggagggcaaggtggtgcagcccgagaacctggagtacaccatcgtcatcacgccccactccggggaggagcacgccgtgggcaacgacacggggaagcacggcaaggagatcaagatcaccccgcagagctccatcaccgaggccgagctgaccgggtacggcaccgtgacgatggagtgcagcccccgcaccggcctcgacttcaacgagatggtcctgctgcagatggaggacaaggcctggctcgtgcaccggcagtggttcctggacctgcccctcccctggctgccgggggccgacacccagggctccaactggatccagaaggagaccctggtgacgttcaagaacccccacgcgaagaagcaggacgtcgtggtcctcgggagccaggagggcgccatgcacaccgccctgaccggggccaccgagatccagatgagctccggcaacctcctcttcacgggccacctgaagtgccgcctgcggatggacaagctccagctgaaggggatgagctactccatgtgcaccggcaagttcaagatcgtgaaggagatcgccgagacccagcacgggaccatcgtgatccgcgtccagtacgagggcgacggcagcccctgcaagatccccttcgagatcacggacctggagaagcggcacgtgctcgggcgcctgatcaccgtgaacccgatcgtcaccggcaaggactcccccgtgaacatcgaggcggagccgcccttcggggacagctacatcatcatcggcgtggagccggggcagctgaagctcaactggttcaagaagggctccagcatcggccagatgttcgagaccacgatgcgcggggccaagcggatggccatcctgggcgacaccgcctgggacttcgggtccctgggcggggtcttcaccagcatcggcaaggccctccaccaggtgttcggcgcgatctacggggccgccttctccggcgtgagctggaccatgaagatcctgatcggggtcatcatcacgtggatcggcatgaactcccgcagcacctccctgagcgtgtccctggtgctcgtcggggtggtgaccctgtacctgggcgccatggtccaggcggacagcggctgcgtggtgtcctggaagaacaaggagctcaagtgcgggagcggcatcttcatcaccgacaacgtccacacgtggaccgagcagtacaagttccagcccgagagcccctccaagctggccagcgccatccagaaggcccacgaggaggggatctgcggcatccggtccgtgacccgcctggagaacctcatgtggaagcagatcacccccgagctgaaccacatcctgagcgagaacgaggtgaagctcacgatcatgaccggggacatcaagggcatcatgcaggccggcaagcggtccctgcgcccgcagcccaccgagctgaagtacagctggaagacctgggggaaggcgaagatgctctccacggagagccacaaccagaccttcctgatcgacggccccgagaccgccgagtgcccgaacaccaaccgggcctggaactccctggaggtcgaggactacgggttcggcgtgttcacgaccaacatctggctcaagctgcgcgagaagcaggacgtgttctgcgacagcaagctgatgtccgccgccatcaaggacaaccgggcggtccacgccgacatgggctactggatcgagagcgccctcaacgacacctggaagatggagaaggcctccttcatcgaggtcaagagctgccactggcccaagtcccacaccctgtggagcaacggggtgctggagtccgagatgatcatccccaagaacttcgccggccccgtgagccagcacaactaccgcccggggtaccacacccagacggcgggcccctggcacctcgggaagctggagatggacttcgacctgtgcgagggcaccaccgtggtggtcaccgaggactgcggcaaccgggggcccagcctccgcacgaccaccgcctccggcaagctgatcaccgagtggtgctgccggagctgcacgctgcccccgctccgctaccgcggggaggacggctgctggtacgggatggagatccgccccctgaaggagaaggaggagaacctggtgaactccctcgtgaccgccggccacggccaggtcgacaacttcagcctgggggtgctgggcatggccctcttcctggaggagatgctgcggacccgcatcgggaccaagcacgcgatcctcctggtggccgcctccttcgtcacgctgatcaccggcaacatgagcttccgggacctcgggcgcgtgatggtgatggtcggcgccaccatgaccgacgacatcggcatgggggtgacgtacctggccctgctcgcggccttcaaggtgcgccccaccttcgccgccggcctgctgctccggaagctgacctccaaggagctgatgatggccaccatcgggatcgcgctcctgagccagtccacgatccccgagaccatcctggagctcaccgacgccctggccctgggcatgatggtcctcaagatcgtgcgcaacatggagaagtaccagctggccgtgaccatcatggccatcagctgcgtcccgaacgcggtgatcctgcagaacgcctggaaggtgtcctgcacgatcctcgccgccgtcagcgtgagccccctgctgctcaccagctcccagcagaaggcggactggatccccctggccctgaccatcaagggcctcaaccccaccgccatcttcctgacgaccctgagccggacctccaagaagcgcagctggccgctcaacgaggccgtcatggccgtggggatggtgtccatcctggcgagcagcctgctcaagaacgacatccccatgaccggccccctggtcgccgggggcctgctcacggtgtgctacgtgctgaccgggcggtccgccgacctggagctcgagcgcgccgccgacgtcaagtgggaggaccaggcggagatcagcggctccagccccatcctgtccatcaccatcagcgaggacggctccatgagcatcaagaacgaggaggaggagcagaccctgacgatcctcatccggaccgggctgctggtgatctccggcgtgttcccggtcagcatccccatcaccgccgccgcctggtacctctgggaggtgaagaagcagcgcgccggggtgctgtgggacgtccccagcccgccgcccgtggagaaggcggagctggaggacggcgcctaccggatcaagcagcgcgggatcctcggctacagccagatcggcgccggggtgtacaaggagggcaccttccacaccatgtggcacgtcacgcgcggggccgtgctgatgcaccgcggcaagcggatcgagccctcctgggccgacgtgaagaaggacctgatcagctacgggggcggctggaagctcgagggggagtggaaggagggcgaggaggtccaggtgctggcgctggagcccgggaagaacccccgcgccgtgcagaccaagcccggcatcttcaagaccaacaccgggacgatcggcgccgtctccctcgacttcagccccggcacctccgggagccccatcgtggaccggaagggcaaggtggtcgggctgtacggcaacggcgtggtgacccgctccggggcctacgtcagcgcgatcgcccagaccgagaagtccatcgaggacaaccccgagatcgaggacgacatcttccggaagaagcgcctgacgatcatggacctccaccccggcgccgggaagaccaagcggtacctgcccgccatcgtgcgcgaggccatcaagcggggcctgcgcaccctgatcctcgcgccgacccgcgtggtcgccgccgagatggaggaggccctgcgggggctgcccatccgctaccagacgcccgccatcaagaccgagcacaccggccgggagatcgtggacctcatgtgccacgcgaccttcacgatgcgcctgctgtcccccgtgcgggtcccgaactacaacctcatcatcatggacgaggcccacttcaccgaccccgccagcatcgccgcccgcggctacatctccacccgggtggagatgggggaggcggccggcatcttcatgaccgccacgccgcccgggagccgcgacccgttcccccagtccaacgcccccatcatggacgaggagcgggagatccccgagcgcagctggaactccggccacgagtgggtgaccgacttcaaggggaagaccgtctggttcgtgccgagcatcaaggcgggcaacgacatcgccgcctgcctgcggaagaacggcaagaaggtgatccagctgtcccgcaagaccttcgacagcgagtacgtcaagacgcgggccaacgactgggacttcgtggtgaccaccgacatctccgagatgggggccaacttcaaggcggagcgcgtcatcgacccccggcgctgcatgaagcccgtgatcctcaccgacggcgaggagcgggtgatcctggccgggcccatgccggtcacgcacagctccgccgcccagcgccggggccgcatcgggcgcaaccccaagaacgagaacgaccagtacatctacatgggcgagcccctggagaacgacgaggactgcgcccactggaaggaggcgaagatgctcctggacaacatcaacacccccgagggcatcatcccgagcatgttcgagcccgagcgggagaaggtggacgccatcgacggggagtaccgcctgcggggcgaggcccgcaagaccttcgtggacctcatgcggcgcggggacctgcccgtctggctggcctacaaggtggccgcggagggcatcaactacgccgaccggaagtggtgcttcgacgggatcaagaacaaccagatcctcgaggagaacatggaggtggagatctggaccaaggagggcgagcgcaagaagctgaagccgcggtggctggacgcccgcatctactccgaccccctcgccctgaaggagttcaaggagttcgcggccggccgcaagagcctgacgctcaacctgatcaccgagatggggcgcctgcccaccttcatgacccagaaggcccggaacgccctcgacaacctggccgtcctgcacacggcggagaccggcgggaaggcctacaaccacgccctctccgagctgcccgagaccctggagaccctcctgctgctcacgctgctggccaccgtgaccggcggcatcttcctcttcctgatgagcgggaagggcatcgggaagatgaccctgggcatgtgctgcatcatcaccgcctccatcctcctgtggtacgcgcagatccagccgcactggatcgccgccagcatcatcctggagttcttcctcatcgtcctgctgatccccgagcccgagaagcagcgcacgccccaggacaaccagctcacctacgtggtgatcgccatcctgaccgtcgtggccgcgaccatggccaacgagatggggttcctggagaagacgaagaaggacctcggcttcggcagcatcaccacccaggagtccgagagcaacatcctggacatcgacctgcggccggcctccgcctggaccctctacgccgtggcgacgaccttcgtcacccccatgctgcgccacagcatcgagaactccagcgtgaacgtgtccctgaccgccatcgccaaccaggccacggtcctcatggggctgggcaaggggtggcccctgagcaagatggacatcggcgtgcccctcctggcgatcgggtgctactcccaggtgaacccgatcaccctgaccgccgccctcctgctgctcgtcgcccactacgccatcgtgggccccggcctgcaggcgaaggccacccgggaggcccagaagcgcgccgccgcggggatcatgaagaaccccacggtggacggcatcaccgtcatcgacctggagcccatcccgtacgaccccaagttcgagaagcagctcggccaggtgatgctgctgatcctctgcgtgacccaggtcctgatgatgcggaccacgtgggccctgtgcgaggccctcaccctggccaccggccccatcagcaccctgtgggaggggaaccccggccgcttctggaacacgaccatcgccgtgtccatggcgaacatcttccggggcagctacctcgccggggccggcctgctgttctccatcatgaagaacaccaccaacacgcgccgcgggaccggcaacatcggcgagaccctcggggagaagtggaagtcccggctgaacgccctgggcaagtccgagttccagatctacaagaagtccgggatccaggaggtggaccgcaccctcgcgaaggagggcatcaagcgcggggagacggaccaccacgccgtctcccgcggcagcgccaagctgcggtggttcgtggagcgcaacatggtgaccccggagggcaaggtcgtggacctggggtgcggccgcggcgggtggtcctactactgcggcgggctcaagaacgtgcgcgaggtcaaggggctgaccaagggcgggcccgggcacgaggagcccatccccatgagcacctacggctggaacctggtgcggctccagagcggggtggacgtcttcttcacgccgcccgagaagtgcgacaccctgctgtgcgacatcggcgagtccagccccaaccccaccatcgaggccggccgcaccctccgggtgctgaacctggtggagaactggctcaacaacaacacccagttctgcatcaaggtcctgaacccgtacatgccctccgtgatcgagaagatggagacgctgcagcgcaagtacgggggcgccctcgtgcggaaccccctgagccgcaactccacccacgagatgtactgggtcagcaacgcgaccgggaacatcgtgtccagcgtgaacatgatctcccggatgctgatcaaccgcttcaccatgaagcacaagaaggccacgtacgagccggacgtcgacctgggcagcgggacccggaacatcggcatcgagtccgagatccccaacctcgacatcatcggcaagcgcatcgagaagatcaagcaggagcacgagaccagctggcactacgaccaggaccacccctacaagacctgggcctaccacgggtcctacgagacgaagcagaccggcagcgcctccagcatggtgaacggggtggtccggctgctgaccaagccctgggacgtggtgccgatggtcacccagatggccatgacggacaccacccccttcggccagcagcgcgtgttcaaggagaaggtggacacccgcacgcaggagcccaaggagggcaccaagaagctcatgaagatcaccgcggagtggctgtggaaggagctggggaagcggaagacgccccggatgtgcacgcgggaggagttcacccgcaaggtccggtccaacgccgccctcggcgccatcttcaccgacgagaacaagtggaagtccgcccgcgaggcggtggaggacgggcggttctgggagctggtggaccgcgagcggaacctgcacctcgagggcaagtgcgagacctgcgtctacaacatgatggggaagcgcgagaagaagctgggcgagttcggcaaggccaaggggtcccgggccatctggtacatgtggctgggcgcccgcttcctcgagttcgaggcgctggggttcctgaacgaggaccactggttcagccggggcaacagcctctccggggtggagggcgagggcctgcaccgcctggggtacatcctccgggacgtcggcaagaaggagggcggggccatgtacgccgacgacacggccgggtgggacacccgcatcaccctggaggacctgaagaacgaggagatggtgaccaaccacatgaagggcgagcacaagaagctcgccgaggcgatcttcaagctgacgtaccagaacaaggtggtccgggtgcagcgcccgacgccccggggcaccgtgatggacatcatcagccgccgggaccagcgcgggtccggccaggtcgggacctacggcctgaacacgttcaccaacatggaggcccagctcatccgccagatggagggcgaggggatcttcaagagcatccagcacctgaccgccaccgaggaggtggccgtgcagaactggctggcccgggtcggccgcgagcggctctcccgcatggcgatcagcggggacgactgcgtggtgaagcccatcgacgaccggttcgcctccgccctgacggccctgaacgacatgggcaaggtccgcaaggacatccagcagtgggagcccagccgggggtggaacgactggacccaggtgccgttctgctcccaccacttccacgagctcgtgatgaaggacggccgcgtcctggtggtgccctgccggaaccaggacgagctgatcggccgcgcccggatcagccagggggcgggctggtccctcaaggagaccgcctgcctgggcaagagctacgcccagatgtggaccctgatgtacttccaccgccgggacctccgcctggccgccaacgcgatctgctccgccgtccccagccactgggtgcccacctcccggacgacctggagcatccacgccaagcacgagtggatgaccaccgaggacatgctggccgtgtggaaccgcgtctggatccaggagaacccgtggatggaggacaagacgcccgtggagtcctgggaggaggtgccctacctcggcaagcgggaggaccagtggtgcgggagcctgatcggcctgaccagccgcgcgacctgggccaagaacatccagaccgccatcaaccaggtccggtccctcatcggcaacgaggagtacacggactacatgcccagcatgaagcgcttccgccgggaggaggaggaggccggggtgctgtggtga

SEQ ID NO: 9190 - RNA, 9876 nt, synthetic construct
  misc_feature 1..9876: note = derived and/or modified CDS sequence (opt1) from DENV-2__GQ868588__SS-prME
  source 1..9876: mol_type = other RNA
accgcgggcatgatcatcatgctgatccccaccgtgatggccttccacctcaccacccggaacggggagccccacatgatcgtgagccggcaggagaagggcaagtccctgctgttcaagaccaaggacgggaccaacatgtgcaccctcatggcgctggacctgggcgagctctgcgaggacaccatcacctacaagtgccccttcctgaagcagaacgagcccgaggacatcgactgctggtgcaacagcacctccacgtgggtgacctacgggacctgcaccacgaccggcgagcaccgccgggagaagcgcagcgtggccctggtcccccacgtgggcatggggctcgagacccggaccgagacgtggatgtccagcgagggcgcctggaagcacgcccagcgcatcgagacctggatcctgcggcaccccgggttcaccatcatggccgcgatcctggcctacaccatcggcacgacccacttccagcgcgtgctcatcttcatcctgctgaccgccatcgccccctccatggcgatgcggtgcatcgggatcagcaaccgcgacttcgtcgagggcgtgtccggcgggagctgggtggacatcgtcctcgagcacggctcctgcgtgaccacgatggccaagaacaagcccaccctggacttcgagctgatcaagaccgaggccaagcagcccgccaccctccggaagtactgcatcgaggccaagctgacgaacaccaccaccgacagccgctgccccacgcagggggagcccaccctgaacgaggagcaggacaagcggttcgtgtgcaagcactccatggtcgaccgcggctggggcaacgggtgcggcctcttcgggaagggcgggatcgtgacctgcgcgatgttcacgtgcaagaagaacatggagggcaagatcgtgcagcccgagaacctggagtacacggtcgtgatcacgccccacagcggcgaggagcacgccgtggggaacgacaccggcaagcacgggaaggaggtcaagatcaccccgcagtccagcatcaccgaggccgagctgacgggctacgggaccgtgaccatggagtgcagcccccggaccggcctcgacttcaacgagatggtgctgctgcagatggaggacaaggcctggctcgtccaccgccagtggttcctggacctgcccctcccctggctgccgggcgccgacacgcaggggagcaactggatccagaaggagaccctggtgaccttcaagaacccccacgcgaagaagcaggacgtggtcgtgctcggctcccaggagggggccatgcacaccgccctgacgggcgccaccgagatccagatgagcagcgggaacctcctgttcaccggccacctgaagtgccggctgcgcatggacaagctccagctgaagggcatgtcctacagcatgtgcaccgggaagttcaagatcgtcaaggagatcgccgagacgcagcacggcaccatcgtgatccgggtgcagtacgagggggacggctccccctgcaagatccccttcgagatcatggacctggagaagcgccacgtcctcggccggctgatcaccgtgaacccgatcgtgaccgagaaggacagccccgtcaacatcgaggcggagccgcccttcggggactcctacatcatcatcggcgtggagccggggcagctgaagctcgactggttccgcaagggcagctccatcgggcagatgttcgagacgaccatgcgcggcgccaagcggatggccatcctgggcgacaccgcctgggacttcgggagcctgggcggggtgttcacctccatcggcaaggccctccaccaggtcttcggggcgatctacggcgccgccttcagcggcgtgtcctggacgatgaagatcctgatcggggtgatcatcacctggatcggcatgaacagccgctccaccagcctgtccgtcagcctggtgctcgtggggatcgtcaccctgtacctgggcgtgatggtgcaggccgactccgggtgcgtcgtgagctggaagaacaaggagctcaagtgcggctccggcatcttcgtgacggacaacgtccacacctggaccgagcagtacaagttccagcccgagagccccagcaagctggcgtccgccatccagaaggcccacgaggaggggatctgcggcatccggagcgtgacccgcctggagaacctcatgtggaagcagatcacgtccgagctgaaccacatcctgagcgagaacgaggtgaagctcaccatcatgaccggggacatcaagggcatcatgcaggtcgggaagcggtccctgcgcccccagccgaccgagctgcggtacagctggaagacgtggggcaaggccaagatgctctccaccgagctgcacaaccagaccttcctgatcgacggccccgagaccgccgagtgccccaacacgaaccgcgcgtggaacagcctcgaggtggaggactacgggttcggcgtgttcaccaccaacatctggctgcggctgcgcgagaagcaggacgtcttctgcgactccaagctcatgagcgccgccatcaaggacaaccgggccgtgcacgccgacatggggtactggatcgagtccgcgctgaacgacacctggaagatcgagaaggccagcttcatcgaggtgaagtcctgccactggcccaagagccacaccctgtggtccaacggcgtcctcgagagcgagatggtgatccccaagaacttcgccggccccgtgtcccagcacaacaaccgccccgggtaccacacgcagaccgccggcccgtggcacctggggaagctggagatggacttcgacttctgcgagggcaccaccgtcgtggtgacggaggagtgcgggaaccggggccccagcctccgcaccaccaccgccagcggcaagctgatcacggagtggtgctgccggtcctgcaccctgccgcccctgcgctaccgcggggaggacggctgctggtacgggatggagatccgcccgctgaaggagaaggaggagaacctggtcagctccctcgtgaccgcgggccacgggcagatcgacaacttcagcctgggcatcctgggcatggccctcttcctggaggagatgctgcggacccgcgtggggacgaagcacgccatcctcctggtcgccgtgtccttcgtgaccctgatcaccggcaacatgagcttccgcgacctcgggcgggtcatggtgatggtgggcgcgaccatgacggacgacatcgggatgggcgtcacctacctggccctgctcgccgccttcaaggtgcgccccaccttcgccgcgggcctgctgctccggaagctgacctccaaggagctgatgatgacgaccatcgggatcgtgctcctgagccagtccagcatccccgagaccatcctggagctcaccgacgccctggccctgggcatgatggtcctcaagatggtgcgcaacatggagaagtaccagctggccgtgacgatcatggccatcctgtgcgtccccaacgcggtgatcctccagaacgcctggaaggtctcctgcaccatcctggccgtggtgagcgtctccccgctgctcctgaccagctcccagcagaaggccgactggatccccctggccctcaccatcaaggggctgaaccccacggcgatcttcctgaccaccctcagccggacctccaagaagcgcagctggcccctgaacgaggccatcatggccgtgggcatggtgtccatcctggccagcagcctcctgaagaacgacatcccgatgacgggccccctggtcgccgggggcctcctgaccgtgtgctacgtgctgaccgggcggtccgccgacctcgagctggagcgcgccaccgacgtcaagtgggacgaccaggccgagatcagcggctccagccccatcctgtccatcacgatcagcgaggacgggtccatgagcatcaagaacgaggaggaggagcagaccctcaccatcctgatccggaccggcctgctcgtgatctccggcctgttccccgtgagcatcccgatcaccgccgcggcctggtacctgtgggaggtcaagaagcagcgcgccggggtgctctgggacatccccagcccgccgcccgtgggcaaggccgagctggaggacggggcctaccggatcaagcagaagggcatcctggggtacagccagatcggcgcgggcgtctacaaggaggggacgttccacaccatgtggcacgtgacccgcggcgccgtgctcatgcacaaggggaagcggatcgagccctcctgggccgacgtcaagaaggacctgatcagctacggcgggggctggaagctggagggcgagtggaaggagggggaggaggtccaggtgctcgccctggagcccggcaagaacccgcgcgccgtccagaccaagcccgggctgttccggacgaacaccggcaccatcggggcggtgtccctcgacttcagccccggcacctccggcagccccatcgtggacaagaaggggaaggtcgtgggcctgtacgggaacggcgtggtcacgcgctccggcgcctacgtgagcgccatcgcccagaccgagaagtccatcgaggacaacccggagatcgaggacgacatcttccggaagcgccggctgaccatcatggacctgcaccccggggccggcaagaccaagaagtacctccccgcgatcgtgcgcgaggccatcaagcgggggctgcgcacgctgatcctcgcccccacccgcgtcgtggccgcggagatggaggaggccctgcggggcctgccgatccgctaccagacccccgccatccgggccgagcacaccgggcgcgagatcgtggacctcatgtgccacgccacgttcaccatgcggctgctgtcccccatccgcgtccccaactacaacctcatcatcatggacgaggcgcacttcaccgacccggccagcatcgccgcccggggctacatctccacccgcgtggagatgggcgaggccgcggggatcttcatgacggccacgccgcccggcagccgggaccccttcccgcagtccaacgcccccatcatggacgaggagcgcgagatccccgagcggagctggaactccgggcacgagtgggtgaccgacttcaagggcaagaccgtctggttcgtgcccagcatcaagacggggaacgacatcgccgcctgcctgcgcaagaacggcaagcgggtgatccagctgtcccgcaagaccttcgacagcgagtacgtcaagacccggaccaacgactgggacttcgtggtgacgaccgacatctccgagatgggcgcgaacttcaaggccgagcgcgtcatcgacccgcggcgctgcatgaagcccgtgatcctcaccgacggggaggagcgggtgatcctggccggccccatgcccgtcacccacagctccgccgcgcagcgccgcgggcggatcggccgcaacccgcggaacgagaacgaccagtacatctacatgggggagcccctggagaacgacgaggactgcgcccactggaaggaggccaagatgctcctggacaacatcaacacgcccgagggcatcatccccagcatgttcgagccggagcgcgagaaggtggacgccatcgacggcgagtaccggctgcgcggggaggcccggaagaccttcgtggacctcatgcgccggggcgacctgcccgtctggctggcgtacaaggtggcctccgaggggatcaactacgccgaccgccggtggtgcttcgacggcacccgcaacaaccagatcctcgaggagaacgtggaggtcgagatctggaccaaggagggggagcggaagaagctgaagccccgctggctggacgcccggatctacagcgacccgctcgccctgaaggagttcaaggagttcgcggccggccgcaagtccctgacgctcaacctgatcaccgagatgggccggctgcccaccttcatgacccagaaggcccgcgacgccctcgacaacctggccgtgctgcacacggcggaggccgggggcaaggcctacaaccacgccctcagcgagctgcccgagaccctggagaccctcctgctgctcaccctgctggcgaccgtcaccgggggcatcttcctcttcctgatgtccggccgggggatcggcaagatgaccctggggatgtgctgcatcatcaccgccagcatcctcctgtggtacgcccagatccagccccactggatcgccgccagcatcatcctggagttcttcctcatcgtgctgctgatcccggagcccgagaagcagcgcacgccccaggacaaccagctcacgtacgtgatcatcgcgatcctgaccgtcgtggccgccaccatggccaacgagatgggcttcctggagaagaccaagaaggacctcgggctgggccacatcgccacgcagcagcccgagtccaacatcctggacatcgacctccggccggcgagcgcctggaccctgtacgccgtggccaccaccttcatcacgcccatgctgcgccactccatcgagaacagctccgtcaacgtgagcctcaccgccatcgcgaaccaggccaccgtgctgatgggcctggggaagggctggcccctctccaagatggacatcggggtccccctgctggccatcggctgctacagccaggtgaacccgatcaccctcacggccgccctgctgctcctggtggcgcactacgccatcatcgggcccggcctgcaggccaaggccacccgcgaggcgcagaagcgggccgccgccggcatcatgaagaaccccaccgtcgacgggatcaccgtgatcgacctcgaccccatcccgtacgaccccaagttcgagaagcagctgggccaggtgatgctgctcgtcctgtgcgtgacccaggtgctgatgatgcgcaccacctgggccctctgcgaggcgctgaccctggccacggggcccgtctccaccctctgggagggcaaccccgggcggttctggaacaccaccatcgccgtgagcatggccaacatcttccgcggctcctacctggccggcgcggggctcctcttcagcatcatgaagaacacgacctccacccggcgcggcaccgggaacatcggcgagacgctgggcgagaagtggaagtcccggctgaacgccctcggcaagagcgagttccagatctacaagaagtccgggatccaggaggtggaccgcaccctggccaaggaggggatcaagcggggcgagaccgaccaccacgccgtctcccgcgggagcgccaagctgcggtggttcgtggagcgcaacctcgtgaccccggagggcaaggtcgtggacctgggctgcgggcggggcgggtggtcctactactgcggcgggctgaagaacgtgcgcgaggtcaagggcctcacgaagggcgggcccggccacgaggagcccatccccatgagcacctacgggtggaacctggtgcggctgcagagcggcgtggacgtcttcttcgtgccgcccgagaagtgcgacaccctcctgtgcgacatcggggagtccagccccaaccccaccgtggaggcgggccgcaccctgcgggtcctcaacctggtggagaactggctgaacaacaacacgcagttctgcgtgaaggtcctgaacccgtacatgccctccgtgatcgagcgcatggagaccctccagcggaagtacggcggggccctggtgcgcaaccccctgagccgcaactccacccacgagatgtactgggtcagcaacgcctccggcaacatcgtgagctccgtgaacatgatcagccggatgctcatcaaccgcttcaccatgcggcacaagaaggccacgtacgagccggacgtcgacctggggtccggcacccgcaacatcgggatcgagagcgagacccccaacctggacatcatcggcaagcggatcgagaagatcaagcaggagcacgaggcgtcctggcactacgaccaggaccacccctacaagacctgggcctaccacggcagctacgagacgaagcagaccgggtccgccagctccatggtgaacggcgtggtccgcctcctgaccaagccctgggacgtggtgccgatggtcacccagatggccatgacggacaccacccccttcgggcagcagcgggtgttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcaccaagaaggtccggagcaacgcggccctgggggccatcttcaccgacgagaacaagtggaagtccgcccgcgaggccgtggaggacaaccggttctgggagctcgtcgacaaggagcgcaacctgcacctggagggcaagtgcgagacctgcatctacaacatgatggggaagcgggagaagaagctcggcgagttcgggaaggcgaagggcagccgcgccatctggtacatgtggctgggcgcccggttcctggagttcgaggccctcgggttcctgaacgaggaccactggttcagccgcgagaactccctgagcggcgtggagggggagggcctccacaagctggggtacatcctgcgggaggtgtccaagaaggagggcggcgccatgtacgcggacgacacggccgggtgggacacccgcatcaccatcgaggacctcaagaacgaggagatgatcaccaaccacatggccggcgagcacaagaagctggccgaggcgatcttcaagctgacgtaccagaacaaggtcgtgcgggtgcagcgcccgacgccccgcgggaccgtcatggacatcatcagccggcgcgaccagcggggctccggccaggtggggacctacggcctcaacaccttcaccaacatggaggcccagctgatccgccagatggagggggagggcatcttcaagagcatccagcacctgaccgcctccgaggagatcgccgtgcaggactggctcgtccgggtggggcgcgagcggctgagccgcatggccatctccggcgacgactgcgtggtcaagcccctggacgaccggttcgcgcgcgccctcaccgccctgaacgacatgggcaaggtgcggaaggacatccagcagtgggagcccagccgcgggtggaacgactggacccaggtgccgttctgctcccaccacttccacgagctgatcatgaaggacggccggatcctcgtcgtgccctgccgcaaccaggacgagctgatcgggcgggcccgcatcagccagggcgccgggtggtccctgcgggagaccgcgtgcctcggcaagagctacgcccagatgtggtccctgatgtacttccaccgccgggacctgcgcctcgccgccaacgccatctgcagcgcggtgccctcccactgggtccccaccagccgcaccacctggagcatccacgcctcccacgagtggatgacgaccgaggacatgctgaccgtgtggaaccgggtgtggatcctggagaacccgtggatggaggacaagacccccgtcgagagctgggaggagatcccctacctcggcaagcgcgaggaccagtggtgcgggtccctgatcggcctgacgagccgggccacctgggccaagaacatccagaccgccatcaaccaggtgcgctccctcatcgggaacgaggagtacaccgactacatgcccagcatgaagcggttccgccgggaggaggaggaggcgggcgtgctgtggtga

SEQ ID NO: 9191 - RNA, 9876 nt, synthetic construct
  misc_feature 1..9876: note = derived and/or modified CDS sequence (opt1) from DENV-2__GQ868590__SS-prME
  source 1..9876: mol_type = other RNA
accgcgggcatgatcatcatgctgatccccaccgtgatggccttccacctcaccacccggaacggggagccccacatgatcgtgagccggcaggagaagggcaagagcctgctgttcaagaccaaggacgggaccaacatgtgcaccctcatggcgatggacctgggcgagctgtgcgaggacaccatcacctacaagtgccccttcctcaagcagaacgagcccgaggacatcgactgctggtgcaacagcacctccacctgggtgacctacgggacctgcaccacgaccggcgagcaccggcgggagaagcgcagcgtggccctggtgccccacgtgggcatggggctggagacccggaccgagacgtggatgtccagcgagggcgcctggaagcacgcccagcggatcgagacctggatcctccggcacccggggttcaccatcatggccgcgatcctggcctacaccatcggcacgacccacttccagcgcgtgctgatcttcatcctcctgaccgccatcgccccctccatgaccatgcggtgcatcgggatcagcaaccgcgacttcgtcgagggcgtgtccggcgggagctgggtggacatcgtcctggagcacggctcctgcgtgacgaccatggcgaagaacaagcccaccctcgacttcgagctgatcaagaccgaggccaagcagcccgccacgctgcggaagtactgcatcgaggccaagctcaccaacaccaccacggacagccgctgccccacccagggggagcccaccctgaacgaggagcaggacaagcggttcgtgtgcaagcactccatggtcgaccgcggctggggcaacgggtgcggcctgttcgggaagggcgggatcgtgacctgcgccatgttcacgtgcaagaagaacatggagggcaagatcgtgcagcccgagaacctcgagtacaccgtcgtgatcacgccccacagcggcgaggagcacgcggtggggaacgacaccggcaagcacgggaaggaggtcaagatcaccccgcagtccagcatcacggaggccgagctgaccggctacgggaccgtgaccatggagtgcagcccccggacgggcctggacttcaacgagatggtgctcctgcagatggaggacaaggcctggctggtccaccgccagtggttcctcgacctgcccctgccctggctcccgggcgccgacacccaggggagcaactggatccagaaggagaccctggtgaccttcaagaacccccacgccaagaagcaggacgtggtcgtgctgggctcccaggagggggcgatgcacacggccctcaccggcgccaccgagatccagatgagcagcgggaacctgctgttcaccggccacctcaagtgccggctgcgcatggacaagctgcagctcaagggcatgtcctacagcatgtgcacggggaagttcaagatcgtcaaggagatcgccgagacccagcacggcaccatcgtgatccgggtgcagtacgagggggacggctccccctgcaagatccccttcgagatcatggacctggagaagcgccacgtcctgggccggctcatcaccgtgaacccgatcgtgacggagaaggacagccccgtcaacatcgaggccgagccgcccttcggggactcctacatcatcatcggcgtggagccggggcagctgaagctggactggttcaagaagggcagctccatcgggcagatgttcgagaccaccatgcgcggcgcgaagcgcatggccatcctcggcgacaccgcctgggacttcgggagcctgggcgggatgttcacgtccatcggcaaggccctgcaccaggtgttcggggccatctacggcgcggccttcagcggcgtctcctggaccatgaagatcctcatcggggtgatcatcacctggatcggcatgaacagccggtccaccagcctgtccgtgagcctggtcctggtggggatcgtgacgctctacctgggcgtcatggtgcaggccgactccgggtgcgtggtcagctggaagaacaaggagctgaagtgcggctccggcatcttcgtgaccgacaacgtgcacacctggaccgagcagtacaagttccagcccgagagccccagcaagctcgcctccgcgatccagaaggcccacgaggaggggatctgcggcatccgcagcgtcacgcggctggagaacctgatgtggaagcagatcacccccgagctcaaccacatcctgtccgagaacgaggtgaagctgaccatcatgaccggggacacgaagggcatcatgcaggtcgggaagcgcagcctccggccgcagcccaccgagctgcgctactcctggaagacctggggcaaggccaagatgctgcccaccgagctccacaaccagacgttcctgatcgacggcccggagaccgccgagtgccccaacaccaaccgggcctggaacagcctggaggtcgaggactacgggttcggcgtgttcaccaccaacatctggctccgcctgcgggagaagcaggacgtgttctgcgactccaagctgatgagcgcggccatcaaggacaaccgcgccgtccacgccgacatggggtactggatcgagtccgccctcaacgacacgtggaagatcgagaaggcgagcttcatcgaggtgaagtcctgccactggcccaagagccacaccctgtggtccaacggcgtgctggagagcgagatggtcatccccaagaacctcgccggcccggtgtcccagcacaacaaccggcccgggtaccacacccagaccgccggcccctggcacctggggaagctggagatggacttcaacttctgcgagggcacgaccgtggtcgtgaccgaggagtgcgggaaccgcggccccagcctccggaccacgaccgcctccggcaagctgatcaccgagtggtgctgccgcagctgcaccctgccgcccctccggtaccgcggggaggacggctgctggtacgggatggagatccggcccctgaaggagaaggaggagaacctggtgagctccctcgtcacggccggccacgggcagatcgacaacttcagcctgggcatcctgggcatggccctgttcctggaggagatgctgcgcacccgggtggggaccaagcacgccatcctcctggtggccgtctccttcgtgaccctgatcacgggcaacatgagcttccgcgacctcgggcgcgtgatggtcatggtgggcgccaccatgaccgacgacatcgggatgggcgtgacctacctggcgctgctcgccgcctacaaggtccggcccacgttcgccgccggcctgctgctccgcaagctgacctccaaggagctgatgatgaccaccatcgggatcgtgctcctgagccagtccagcatcccggagacgatcctggagctcaccgacgcgctggccctgggcatgatggtgctcaagatggtccggaacatggagaagtaccagctggccgtgaccatcatggccatcctgtgcgtgcccaacgccgtcatcctccagaacgcgtggaaggtgtcctgcaccatcctggccgtcgtgagcgtgagccccctgctcctgacgagctcccagcagaaggccgactggatccccctggccctcaccatcaaggggctgaacccgaccgccatcttcctgaccacgctcagccgcacctccaagaagcggagctggcccctgaacgaggcgatcatggccgtcggcatggtgtccatcctggccagctccctcctgaagaacgacatccccatgaccggccccctggtggccgggggcctcctgaccgtctgctacgtgctgacggggcgcagcgcggacctcgagctggagaaggccaccgacgtgaagtgggacgaccaggccgagatcagcggctccagcccgatcctgtccatcaccatcagcgaggacgggtccatgagcatcaagaacgaggaggaggagcagaccctcaccatcctgatccggacgggcctgctcgtcatctccggcctgttccccgtgagcatccccatcaccgccgccgcgtggtacctgtgggaggtgaagaagcagcgcgccggggtcctctgggacgtgccctccccgccgcccgtgggcaaggccgagctggaggacggggcctaccggatcaagcagaagggcatcctggggtacagccagatcggcgccggcgtctacaaggaggggaccttccacaccatgtggcacgtgacgcgcggcgcggtgctcatgcacaaggggaagcggatcgagccgtcctgggccgacgtcaagaaggacctgatcagctacggcgggggctggaagctggagggcgagtggaaggagggggaggaggtccaggtgctcgccctggagcccggcaagaacccccgcgccgtccagaccaagcccgggctgttccggaccaacaccggcacgatcggggccgtgtccctcgacttcagcccgggcacctccggcagccccatcgtggacaagaaggggaaggtcgtgggcctgtacgggaacggcgtggtcacccgctccggcgcgtacgtgagcgccatcgcccagaccgagaagtccatcgaggacaaccccgagatcgaggacgacatcttccggaagcgccggctgacgatcatggacctgcaccccggggccggcaagaccaagaagtacctcccggccatcgtgcgcgaggcgatcaagcgggggctgcgcaccctgatcctcgcccccacccgggtcgtggccgccgagatggaggaggcgctgcgcggcctgcccatccgctaccagacgcccgccatccgggccgagcacaccgggcgcgagatcgtggacctcatgtgccacgccaccttcaccatgcggctgctgagcccgatccgcgtccccaactacaacctcatcatcatggacgaggcccacttcacggaccccgcgagcatcgccgcccggggctacatctccacccgcgtggagatgggcgaggccgccgggatcttcatgaccgcgacgccgcccggcagccgggaccccttcccccagtccaacgcccccatcatggacgaggagcgcgagatccccgagcggagctggaactccgggcacgagtgggtgacggacttcaagggcaagaccgtctggttcgtgcccagcatcaagaccgggaacgacatcgccgcctgcctgcgcaagaacggcaagcgggtgatccagctgtcccgcaagaccttcgacagcgagtacgtcaagacgcggaccaacgactgggacttcgtggtgaccaccgacatctccgagatgggcgccaacttcaaggcggagcgcgtcatcgacccccggcgctgcatgaagcccgtgatcctcacggacggggaggagcgggtgatcctggccggcccgatgcccgtcacccacagctccgccgcccagcgccgggggcgcatcggccgcaacccccggaacgagaacgaccagtacatctacatgggggagcccctggagaacgacgaggactgcgcgcactggaaggaggccaagatgctcctggacaacatcaacaccccggagggcatcatccccagcatgttcggccccgagcgcgagaaggtggacgccatcgacggggagtaccggctgcgcggcgaggcccggaagaccttcgtggagctcatgcgccgcggggacctgccggtctggctggcctacaaggtggcgtccgagggcatcaactacgccgaccgccggtggtgcttcgacgggacgcgcaacaaccagatcctcgaggagaacgtggaggtcgagatctggaccaaggagggcgagcggaagaagctgaagccccgctggctggacgcccggatctacagcgaccccctcgccctgaaggagttcaaggagttcgccgcgggccgcaagtccctgaccctcaacctgatcaccgagatggggcggctgcccacgttcatgacccagaaggcccgcgacgccctcgacaacctggccgtgctgcacaccgccgaggcgggcgggaaggcctacaaccacgccctcagcgagctgccggagaccctggagaccctcctgctgctcacgctgctggccaccgtcaccggcggcatcttcctcttcctgatgtccgggcggggcatcgggaagatgaccctgggcatgtgctgcatcatcacggcgagcatcctcctgtggtacgcccagatccagccccactggatcgccgcctccatcatcctggagttcttcctcatcgtgctgctgatccccgagcccgagaagcagcgcaccccgcaggacaaccagctcacctacgtgatcatcgccatcctgaccgtcgtggcggccacgatggccaacgagatggggttcctggagaagaccaagaaggacctcggcctgggccacatcgccacccagcagcccgagagcaacatcctggacatcgacctccggcccgccagcgcgtggaccctgtacgccgtggccacgaccttcatcacccccatgctgcgccactccatcgagaacagctccgtcaacgtgagcctcaccgccatcgccaaccaggcgacggtgctgatggggctgggcaaggggtggccgctctccaagatggacatcggcgtccccctgctggccatcgggtgctacagccaggtgaaccccatcaccctcaccgccgccctgctgctcctggtggcccactacgcgatcatcggccccggcctgcaggccaaggccacccgggaggcccagaagcgcgcggccgccgggatcatgaagaacccgacggtcgacggcatcaccgtgatcgacctcgaccccatcccctacgaccccaagttcgagaagcagctgggccaggtgatgctgctcgtcctgtgcgtgacccaggtgctgatgatgcgcaccacgtgggccctctgcgaggccctgaccctggcgaccgggccggtctccaccctctgggaggggaaccccggccggttctggaacacgaccatcgccgtgagcatggccaacatcttccgcggctcctacctggccggggccggcctcctcttcagcatcatgaagaacaccacctccacgcggcgcgggaccggcaacatcggcgagaccctgggggagaagtggaagtcccggctgaacgcgctcggcaagtccgagttccagatctacaagaagtccgggatccaggaggtggaccgcaccctggccaaggagggcatcaagcgcggggagacggaccaccacgccgtctcccgcggcagcgccaagctgcggtggttcgtggagcgcaacctcgtgacccccgagggcaaggtcgtggacctggggtgcggccgcggcgggtggtcctactactgcggcgggctgaagaacgtgcgcgaggtcaaggggctcaccaagggcggccccgggcacgaggagccgatccccatgagcacctacggctggaacctggtgcggctgcagtccggggtggacgtcttcttcatcccgcccgagaagtgcgacaccctcctgtgcgacatcggcgagagcagcccgaaccccacggtggaggccggccgcaccctgcgggtgctcaacctggtcgagtcctggctgaacaacaacacccagttctgcgtgaaggtgctgaacccctacatgccgagcgtcatcgagcgcatggagaccctccagcggaagtacgggggcgcgctggtgcgcaaccccctgtcccggaacagcacgcacgagatgtactgggtgtccaacgccagcgggaacgtcgtgtccagcgtgaacatgatctcccgcatgctcatcaaccgcttcaccatgcggcacaagaaggccacctacgagcccgacgtcgacctgggcagcgggacccgcaacatcggcatcgagtccgagacgcccaacctggacatcatcggcaagcggatcgagaagatcaagcaggagcacgaggccagctggcactacgaccaggaccacccgtacaagacctgggcgtaccacgggtcctacgagaccaagcagaccggcagcgcctccagcatggtgaacggggtggtccgcctcctgacgaagccctgggacgtggtgcccatggtcacccagatggccatgaccgacaccacgcccttcggccagcagcgggtgttcaaggagaaggtggacacccgcacccaggagccgaaggagggcaccaagaagctgatgaagatcacggccgagtggctctggaaggagctggggaagaagaagacgccccggatgtgcacccgcgaggagttcaccaagaaggtccggtccaacgccgcgctgggcgccatcttcacggacgagaacaagtggaagtccgcccgcgaggccgtggaggacaaccggttctgggagctcgtcgacaaggagcgcaacctgcacctggaggggaagtgcgagacctgcgtgtacaacatgatgggcaagcgggagaagaagctcggggagttcggcaaggccaagggctcccgcgcgatctggtacatgtggctgggggcccggttcctggagttcgaggccctcggcttcctgaacgaggaccactggttcagccgcgagaacagcctgtccggggtggagggcgaggggctccacaagctgggctacatcctgcgggaggtcagcaagaaggagggcggggccatgtacgccgacgacaccgcgggctgggacacccgcatcacgatcgaggacctcaagaacgaggagatgatcaccaaccacatggccggggagcacaagaagctggccgaggccatcttcaagctgacctaccagaacaaggtggtgcgggtccagcgccccacccccatcggcacggtgatggacatcatctcccggcgcgaccagcgcgggagcggccaggtgggcacctacgggctcaacaccttcaccaacatggaggcgcagctgatccggcagatggagggcgaggggatcttcaagtccatccagcacctgacggccagcgaggagatcgccgtccaggactggctcgtgcgcgtgggccgggagcgcctgtcccggatggccatcagcggcgacgactgcgtcgtgaagccgctggacgaccgcttcgcccgggcgctcaccgccctgaacgacatggggaaggtgcgcaaggacatccagcagtgggagccctcccggggctggaacgactggacccaggtccccttctgcagccaccacttccacgagctgatcatgaaggacgggcgcaccctcgtggtgccctgccggaaccaggacgagctgatcggccgcgcccggatctcccagggggccggctggagcctgcgcgagaccgcctgcctcggcaagtcctacgcgcagatgtggagcctgatgtacttccaccggcgcgacctgcggctcgccgccaacgccatctgctccgccgtcccgagccactgggtgcccacgtcccgcaccacctggagcatccacgcgagccacgagtggatgaccacggaggacatgctgaccgtgtggaaccgggtctggatcctggagaacccctggatggaggacaagacccccgtggagtcctgggaggagatcccgtacctcgggaagcgcgaggaccagtggtgcggcagcctgatcgggctgacctcccgcgccacgtgggccaagaacatccagaccgccatcaaccaggtgcggagcctcatcggcaacgaggagtacaccgactacatgccctccatgaagcgcttccggcgcgaggaggaggaggccggggtcctgtggtga

SEQ ID NO: 9192 - RNA, 9876 nt, synthetic construct
  misc_feature 1..9876: note = derived and/or modified CDS sequence (opt1) from DENV-2__GQ868497__SS-prME
  source 1..9876: mol_type = other RNA
accgccagcgtgatcgtcatgctgatccccaccgtgatggccttccacctcaccacccgcaacggcgagccccacatgatcgtggggcggcaggagaagggcaagtccctgctgttcaagaccgaggacggggtcaacatgtgcaccctcatggcgatcgacctgggcgagctgtgcgaggacaccatcacctacaagtgccccctcctgcgccagaacgagcccgaggacatcgactgctggtgcaacagcacctccacctgggtgacctacgggacctgcagcaccaccggcgagcaccggcgcgagaagcggtccgtggccctggtcccccacgtgggcatggggctcgagacgcgcaccgagacctggatgagctccgagggcgcctggaagcacgtgcagcggatcgagacctggatcctgcgccacccggggttcacgatcatggccgccatcctggcgtacaccatcggcaccacccacttccagcgggccctcatcttcatcctgctgacggccgtcgcccccagcatgaccatgcgctgcatcgggatctccaaccgggacttcgtggagggcgtgagcggcgggtcctgggtcgacatcgtgctcgagcacggcagctgcgtgaccaccatggcgaagaacaagcccacgctggacttcgagctgatcaagaccgaggccaagcagcccgccaccctccgcaagtactgcatcgaggccaagctgaccaacacgaccaccgagtcccggtgcccgacccagggggagcccagcctgaacgaggagcaggacaagcgcttcatctgcaagcactccatggtcgaccggggctggggcaacgggtgcggcctcttcgggaagggcgggatcgtgacgtgcgccatgttcacgtgcaagaagaacatggagggcaaggtgatgcagcccgagaacctggagtacaccatcgtcatcacgccccacagcggcgaggagcacgcggtggggaacgacacgggcaagcacgggaaggagatcaagatcaccccgcagtccagcatcaccgaggccgagctgaccggctacgggaccgtgacgatggagtgcagcccccggaccggcctcgacttcaacgagatggtcctgctgcagatggaggacaaggcctggctcgtgcaccggcagtggttcctggacctgcccctcccctggctgccgggcgccgacacccaggggagcaactggatccagaaggagaccctggtgacgttcaagaacccccacgccaagaagcaggacgtcgtggtcctcggcagccaggagggggcgatgcacaccgccctgaccggcgccaccgagatccagatgtccagcgggaacctcctgttcacgggccacctgaagtgccgcctgcggatggacaagctccagctgaagggcatgtcctacagcatgtgcaccgggaagttcaagatcgtgaaggagatcgccgagacccagcacggcaccatcgtgatccgcgtccagtacgagggggacggctccccctgcaagatccccttcgagatcacggacctggagaagcggcacgtgctcggccgcctgatcaccgtgaacccgatcgtcaccgagaaggacagccccgtgaacatcgaggccgagccgcccttcggggactcctacatcatcatcggcgtggagccggggcagctgaagctcaactggttcaagaagggcagctccatcgggcagatgttcgagaccacgatgcgcggcgcgaagcggatggccatcctgggcgacaccgcctgggacttcgggagcctgggcggggtcttcacctccatcggcaaggccctccaccaggtgttcggggccatctacggcgcggccttcagcggcgtgtcctggaccatgaagatcctgatcggggtcatcatcacgtggatcggcatgaacagccgctccaccagcctgtccgtgagcctggtgctcgtcggggtggtgaccctgtacctgggcgccatggtccaggccgactccgggtgcgtggtgagctggaagaacaaggagctcaagtgcggcagcggcatcttcatcaccgacaacgtccacacgtggaccgagcagtacaagttccagcccgagtcccccagcaagctggcgtccgccatccagaaggcccacgaggaggggatctgcggcatccggagcgtgacccgcctggagaacctcatgtggaagcagatcacccccgagctgaaccacatcctgtccgagaacgaggtgaagctcacgatcatgaccggggacatcaagggcatcatgcaggccgggaagcggagcctgcgcccgcagcccaccgagctgaagtactcctggaagacctggggcaaggccaagatgctcagcacggagtcccacaaccagaccttcctgatcgacggccccgagaccgcggagtgcccgaacaccaaccgggcctggaacagcctggaggtcgaggactacgggttcggcgtgttcacgaccaacatctggctcaagctgcgcgagaagcaggacgtgttctgcgactccaagctgatgagcgccgccatcaaggacaaccgggccgtccacgcggacatggggtactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccggccccgtcagccagcacaactaccgcccggggtaccacacccagacggccggcccctggcacctcgggaagctggagatggacttcgacttctgcgagggcaccaccgtggtggtcaccgaggactgcgggaaccggggcccctccctgcgcacgaccaccgcgagcggcaagctcatcaccgagtggtgctgccggtcctgcacgctgcccccgctgcgctaccgcggggaggacggctgctggtacgggatggagatccgccccctcaaggagaaggaggagaacctggtgaacagcctggtgaccgccggccacgggcagatcgacaacttctccctcggcgtcctgggcatggccctgttcctcgaggagatgctgcggacccgcatcgggaccaagcacgccatcctgctcgtggcggccagcttcgtgacgctgatcaccggcaacatgtccttccgggacctggggcgcgtcatggtgatggtgggcgccaccatgaccgacgacatcgggatgggcgtcacgtacctcgccctgctggccgcgttcaaggtgcgccccaccttcgccgccggcctcctgctgcggaagctcaccagcaaggagctgatgatggccaccatcgggatcgccctgctctcccagagcacgatccccgagaccatcctggagctgaccgacgcgctcgccctgggcatgatggtgctgaagatcgtccgcaacatggagaagtaccagctcgccgtgaccatcatggccatctcctgcgtgccgaacgccgtcatcctgcagaacgcgtggaaggtgagctgcacgatcctggccgccgtgtccgtcagccccctcctgctgacctccagccagcagaaggccgactggatccccctcgcgctgaccatcaaggggctgaaccccaccgccatcttcctcacgaccctgtcccggaccagcaagaagcgctcctggccgctgaacgaggccgtgatggccgtcggcatggtgagcatcctcgccagctccctgctgaagaacgacatccccatgaccggccccctcgtggccggcgggctgctgacggtctgctacgtgctcaccgggcggagcgccgacctggagctggagcgcgccgccgacgtgaagtgggaggaccaggccgagatctccgggagctcccccatcctcagcatcaccatctccgaggacgggagcatgtccgtcaagaacgaggaggaggagcagaccctgacgatcctgatccggaccggcctcctggtgatcagcggcgtgttcccggtctccatccccatcaccgcggccgcctggtacctgtgggaggtgaagaagcagcgcgccggggtgctctgggacgtcccctccccgccgcccgtggagaaggccgagctggaggacggcgcgtaccggatcaagcagcgcgggatcctgggctactcccagatcggggccggcgtgtacaaggagggcaccttccacaccatgtggcacgtcacgcgcggggcggtgctcatgcaccggggcaagcggatcgagcccagctgggccgacgtgaagaaggacctgatctcctacgggggcgggtggaagctggagggcgagtggaaggagggcgaggaggtccaggtgctcgccctggagcccgggaagaacccccgcgcggtgcagaccaagcccggcatcttcaagaccaacaccgggacgatcggcgccgtcagcctggacttctcccccgggaccagcggctcccccatcgtggaccggaagggcaaggtggtcgggctctacggcaacggggtggtgacccgcagcggcgcctacgtcagcgccatcgcgcagaccgagaagtccatcgaggacaaccccgagatcgaggacgacatcttccggaagaagcgcctgacgatcatggacctgcaccccggcgccgggaagaccaagcggtacctccccgccatcgtgcgcgaggccatcaagcggggcctgcgcaccctgatcctggccccgacccgcgtggtcgcggccgagatggaggaggccctccgggggctgcccatccgctaccagacgcccgccatcaagaccgagcacaccggccgggagatcgtggacctgatgtgccacgccaccttcacgatgcgcctcctgagccccgtgcgggtcccgaactacaacctgatcatcatggacgaggcgcacttcaccgaccccgcctccatcgccgcccgcgggtacatcagcacccgggtggagatgggcgaggccgcgggcatcttcatgaccgccacgccgcccgggtcccgcgacccgttcccccagagcaacgcccccatcatggacgaggagcgggagatccccgagcgctcctggaacagcggccacgagtgggtgaccgacttcaaggggaagaccgtctggttcgtgccgtccatcaaggccggcaacgacatcgcggcctgcctccggaagaacgggaagaaggtgatccagctgagccgcaagaccttcgactccgagtacgtcaagacgcgggccaacgactgggacttcgtggtgaccaccgacatcagcgagatgggcgccaacttcaaggccgagcgcgtcatcgacccccggcgctgcatgaagcccgtgatcctgaccgacggcgaggagcgggtgatcctcgcggggcccatgccggtcacgcactccagcgccgcccagcgccggggccgcatcgggcgcaaccccaagaacgagaacgaccagtacatctacatgggcgagcccctggagaacgacgaggactgcgcccactggaaggaggccaagatgctgctcgacaacatcaacacccccgaggggatcatcccgtccatgttcgagcccgagcgggagaaggtggacgcgatcgacggcgagtaccgcctgcggggcgaggcccgcaagaccttcgtggacctgatgcggcgcggggacctccccgtctggctggcctacaaggtggccgccgagggcatcaactacgcggaccggaagtggtgcttcgacgggatcaagaacaaccagatcctggaggagaacatggaggtggagatctggaccaaggagggcgagcgcaagaagctcaagccgcggtggctggacgcccgcatctacagcgaccccctggccctcaaggagttcaaggagttcgccgcggggcggaagtccctgacgctgaacctcatcaccgagatgggccgcctgcccaccttcatgacccagaaggcccggaacgccctggacaacctcgccgtcctgcacacggccgaggcgggcgggcgcgcctacaaccacgccctgagcgagctccccgagaccctggagaccctgctcctgctgaccctcctggccacggtgaccggcgggatcttcctgttcctcatgtccggcaagggcatcgggaagatgaccctgggcatgtgctgcatcatcaccgccagcatcctgctctggtacgcgcagatccagccgcactggatcgccgccagcatcatcctggagttcttcctgatcgtcctcctgatccccgagcccgagaagcagcggacgccccaggacaaccagctgacgtacgtggtgatcgccatcctcaccgtcgtggccgcgaccatggccaacgagatggggttcctggagaagaccaagaaggacctgggcctcgggtccatcacgacccaggagagcgagtccaacatcctggacatcgacctgcgcccggccagcgcctggaccctctacgccgtggcgaccacgttcgtcacccccatgctgcggcactccatcgagaacagctccgtgaacgtgagcctgaccgccatcgccaaccaggccaccgtcctcatgggcctgggcaaggggtggcccctgtccaagatggacatcggcgtgcccctcctggcgatcgggtgctacagccaggtgaacccgatcacgctgaccgccgccctcctgctgctcgtcgcccactacgccatcatcggccccgggctgcaggcgaaggccacccgcgaggcccagaagcgggccgccgcgggcatcatgaagaaccccaccgtggacggcatcacggtgatcgacctggagcccatcccgtacgaccccaagttcgagaagcagctcgggcaggtcatgctgctgatcctctgcgtgacccaggtgctgatgatgcgcaccacctgggccctgtgcgaggccctcacgctggccaccggccccatctccaccctgtgggaggggaaccccggccggttctggaacaccacgatcgccgtcagcatggcgaacatcttccgcgggtcctacctcgccggcgccggcctgctgttcagcatcatgaagaacaccaccaacacccgccgggggacgggcaacatcggggagaccctcggcgagaagtggaagtcccgcctgaacgccctgggcaagagcgagttccagatctacaagaagtccgggatccaggaggtggaccggaccctcgcgaaggagggcatcaagcgcggggagaccgaccaccacgccgtgagccggggctccgccaagctgcgctggttcgtcgagcggaacatggtgacgccggaggggaaggtggtcgacctgggctgcggccgcgggggctggagctactactgcgggggcctcaaggacgtgcgggaggtgaaggggctgaccaagggcggccccgggcacgaggagcccatccccatgagcacctacggctggaacctggtccgcctccagtccgggatcgacgtgttcttcaccccgcccgagaagtgcgacacgctgctgtgcgacatcggcgagagctcccccaaccccaccatcgaggccgggcggaccctccgcgtgctgaacctggtcgagaactggctcaacaacaacacccagttctgcatcaaggtgctgaacccgtacatgcccagcgtgatcgagaagatggagaccctgcagcggaagtacggcggcgccctcgtccgcaaccccctgtcccggaacagcacgcacgagatgtactgggtgtccaacgcgaccgggaacatcgtgagctccgtcaacatgatcagccgcatgctgatcaaccggttcaccatgaagcacaagaaggccacctacgagccggacgtggacctgggctccgggacgcgcaacatcggcatcgagagcgagatccccaacctcgacatcatcgggaagcggatcgagaagatcaagcgcgagcacgagacctcctggcactacgaccaggaccacccctacaagacctgggcctaccacggcagctacgagaccaagcagacgggctccgccagctccatggtgaacggggtcgtgcgcctgctgaccaagccctgggacgtggtcccgatggtgacccagatggccatgaccgacacgacccccttcggccagcagcgggtgttcaaggagaaggtcgacacccgcacccaggagcccaaggaggggacgaagaagctcatgaagatcaccgcggagtggctgtggaaggagctgggcaagaagaagacgccccggatgtgcacccgcgaggagttcacgcggaaggtgcgcagcaacgccgccctcggcgccatcttcaccgacgagaacaagtggaagtccgcccgggaggcggtggaggacgggcgcttctgggagctggtcgaccgggagcgcaacctgcacctcgagggcaagtgcgagacctgcgtgtacaacatgatggggaagcgggagaagaagctgggcgagttcgggaaggccaagggcagccgcgccatctggtacatgtggctgggcgcccggttcctcgagttcgaggcgctggggttcctgaacgaggaccactggttcagccgcggcaactccctcagcggggtggagggcgaggggctgcaccggctgggctacatcctccgcgacgtcggcaagaaggagggcggcgccatgtacgccgacgacaccgccgggtgggacacgcggatcaccctggaggacctgaagaacgaggagatggtgaccaaccacatgaagggcgagcacaagaagctcgccgaggcgatcttcaagctgacctaccagaacaaggtcgtgcgcgtgcagcggccgacgccccgcgggaccgtcatggacatcatctcccggcgcgaccagcgcggcagcggccaggtggggacctacggcctgaacaccttcacgaacatggaggcccagctcatccggcagatggagggggagggcatcttcaagtccatccagcacctgaccgccaccgaggagatcgccgtgcagaactggctggcccgcgtcggccgggagcgcctcagccggatggcgatctccggggacgactgcgtggtgaagcccatcgacgaccgcttcgccagcgccctgaccgccctgaacgacatgggcaaggtccggaaggacatccagcagtgggagccctcccgcgggtggaacgactggacccaggtgccgttctgcagccaccacttccacgagctcgtgatgaaggacggccgggtcctggtggtgccctgccgcaaccaggacgagctgatcgggcgggcccgcatctcccagggcgcgggctggagcctcaaggagaccgcctgcctggggaagtcctacgcccagatgtggaccctgatgtacttccaccggcgcgacctccggctggccgccaacgcgatctgcagcgccgtcccctcccactgggtgcccaccagccgcaccacgtggtccatccacgccaagcacgagtggatgaccaccgaggacatgctggccgtgtggaaccgggtctggatccaggagaacccgtggatggaggacaagacccccgtggagagctgggaggaggtgccctacctcggcaagcgcgaggaccagtggtgcgggagcctgatcggcctgacgtcccgggcgacctgggccaagaacatccagaccgccatcaaccaggtccgcagcctcatcgggaacgaggagtacaccgactacatgccctccatgaagcgcttccggaaggaggaggaggaggccggcgtgctgtggtga

SEQ ID NO: 9193 - RNA, 9876 nt, synthetic construct
  misc_feature 1..9876: note = derived and/or modified CDS sequence (opt1) from DENV-2__GU131959__SS-prME
  source 1..9876: mol_type = other RNA
accgcgggcgtgatcgtcatgctgatccccaccgtgatggccttccacctcaccacccgcaacggggagccccacatgatcgtgggccggcaggagaagggcaagagcctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctgggtgacctacgggacctgctccaccaccggcgagcaccggcgcgagaagcggagcgtggccctggtcccccacgtggggatgggcctcgagacccgcaccgagacctggatgtccagcgagggggcctggaagcacgtgcagcggatcgagacctggatcctgcgccacccgggcttcaccatcatggccgccatcctggcgtacaccatcgggaccacccacttccagcgggccctcatcttcatcctgctgacggccgtcgccccctccatgaccatgcgctgcatcggcatcagcaaccgggacttcgtggagggcgtgtccgggggcagctgggtcgacatcgtgctcgagcacgggtcctgcgtgaccaccatggcgaagaacaagcccacgctggacttcgagctgatcaagaccgaggccaagcagcccgccaccctccgcaagtactgcatcgaggccaagctgaccaacacgaccaccgagagccggtgcccgacccagggcgagccctccctgaacgaggagcaggacaagcgcttcatctgcaagcacagcatggtcgaccggggctgggggaacggctgcgggctgttcggcaagggcgggatcgtgacgtgcgccatgttcacgtgcaagaagaacatggagggcaaggtggtccagcccgagaacctggagtacaccatcgtgatcacgccccactccggggaggagcacgcggtgggcaacgacacggggaagcacggcaaggagatcaagatcaccccgcagagctccatcaccgaggccgagctgaccgggtacggcaccgtcacgatggagtgcagcccccgcaccggcctcgacttcaacgagatggtgctgctgcagatggaggacaaggcctggctcgtgcaccggcagtggttcctggacctgcccctcccctggctgccgggggccgacacccagggctccaactggatccagaaggagaccctggtcacgttcaagaacccccacgccaagaagcaggacgtggtcgtgctcgggagccaggagggcgcgatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgccgagacccagcacgggaccatcgtcatccgcgtgcagtacgagggcgacggcagcccctgcaagatccccttcgagatcacggacctggagaagcggcacgtgctcgggcgcctgatcaccgtcaacccgatcgtgaccgagaaggactcccccgtgaacatcgaggccgagccgcccttcggcgacagctacatcatcatcggggtcgagccgggccagctgaagctcaactggttcaagaaggggtccagcatcggccagatgttcgagaccacgatgcgcggcgcgaagcggatggccatcctgggggacaccgcctgggacttcggctccctcggcggggtgttcaccagcatcgggaaggccctccaccaggtgttcggggccatctacggcgcggccttctccggggtcagctggaccatgaagatcctgatcggcgtgatcatcacgtggatcgggatgaacacccgctccaccagcctgtccgtgagcctggtcctcgtgggcgtggtcaccctgtacctgggggccatggtgcaggccgactccggctgcgtggtcagctggaagaacaaggagctcaagtgcggctccgggatcttcatcacggacaacgtgcacacctggaccgagcagtacaagttccagcccgagagccccagcaagctggcgtccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggccaagatgctcagcaccgagtcccacaaccagaccttcctgatcgacgggcccgagaccgcggagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggccgtgcacgcggacatgggctactggatcgagtccgccctcaacgagacctggaagatggagaaggccagcttcatcgaggtgaagtcctgctactggcccaagagccacaccctgtggtccaacggcgtcctggagagcgagatgatcatccccaagaacttcgccgggcccgtgtcccagcacaactaccgcccgggctaccacacgcagaccgccgggccctggcacctcggcaagctggagatggacttcgacctgtgcgaggggaccaccgtggtcgtgacggaggactgcggcaaccggggccccagcctccgcaccaccaccgcgagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacccgcatcggcacgaagcacgccatcctcctggtggcggccagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtcctcaagatcgtgcgcaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccgtcatggccgtgggcatggtgagcatcctggcctccagcctgctcaagaacgacatccccatgacggggcccctggtcgcgggcgggctgctcaccgtgtgctacgtgctgaccggccggagcgccgacctggagctcgagcgcgccgccgacgtcaagtgggaggaccaggccgagatctccgggagctcccccatcctgagcatcaccatctccgaggacggcagcatgtccatcaagaacgaggaggaggagcagacgctgaccatcctcatccggaccggcctgctggtgatcagcggggtgttcccggtctccatccccatcaccgcggccgcctggtacctctgggaggtgaagaagcagcgcgccggcgtgctgtgggacgtccccagcccgccgcccgtggagaaggccgagctggaggacggggcgtaccggatcaagcagcgcggcatcctcgggtactcccagatcggcgccggcgtgtacaaggaggggaccttccacacgatgtggcacgtcacccggggcgccgtgctgatgcaccgcgggaagcggatcgagcccagctgggccgacgtgaagaaggacctgatctcctacggcgggggctggaagctcgagggcgagtggaaggagggggaggaggtccaggtgctggccctggagcccggcaagaacccccgcgcggtgcagaccaagcccgggatcttcaagaccaacacgggcaccatcggggccgtcagcctcgacttctcccccggcaccagcggctcccccatcgtggaccggaaggggaaggtggtcggcctgtacgggaacggcgtggtgacccgcagcggcgcctacgtctccgccatcgcgcagacggagaagtccatcgaggacaaccccgagatcgaggacgacatcttccggaagaagcgcctgaccatcatggacctccaccccggggccggcaagaccaagcggtacctgcccgccatcgtgcgcgaggccatcaagcgggggctgcgcaccctgatcctcgccccgacgcgcgtggtcgcggccgagatggaggaggccctgcggggcctgcccatccgctaccagacccccgccatcaagaccgagcacaccgggcgggagatcgtggacctcatgtgccacgccacgttcaccatgcgcctgctgagccccgtgcgggtcccgaactacaacctcatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctgcggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctcacggacggggaggagcgggtgatcctggcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtggacgcgatcgacggcgagtaccgcctgcgcggggaggcccgcaagaccttcgtggacctcatgcggcgcggcgacctgcccgtctggctggcctacaaggtggccgccgaggggatcaactacgcggaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtcctgcacaccgccgaggccggcgggcgcgcctacaaccacgccctcagcgagctgcccgagaccctggagaccctcctgctgctcacgctgctggccaccgtgaccggcgggatcttcctcttcctgatgtccgggaaggggatcggcaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtgatcgccatcctgaccgtcgtggccgcgaccatggccaacgagatgggcttcctggagaagacgaagaaggacctcgggctgggcagcatcaccacccaggagagcgagtccaacatcctggacatcgacctccgcccggccagcgcctggaccctgtacgccgtggcgacgaccttcgtcacccccatgctgcggcactccatcgagaacagctccgtgaacgtgagcctcaccgccatcgccaaccaggccacggtcctgatgggcctggggaagggctggcccctctccaagatggacatcggggtgcccctgctggcgatcggctgctacagccaggtgaacccgatcaccctcaccgccgccctgctgctcctggtcgcccactacgccatcatcgggcccggcctgcaggcgaaggccacccgcgaggcccagaagcgggccgccgcgggcatcatgaagaaccccacggtggacgggatcaccgtgatcgacctcgagcccatcccgtacgaccccaagttcgagaagcagctgggccaggtcatgctgctcatcctgtgcgtgacccaggtgctgatgatgcgcaccacgtgggccctctgcgaggccctgaccctggccaccgggcccatctccaccctctgggagggcaaccccgggcggttctggaacacgaccatcgccgtcagcatggcgaacatcttccgcggctcctacctggccggcgccgggctcctgttcagcatcatgaagaacaccaccaacacgcgccggggcaccgggaacatcggcgagaccctgggcgagaagtggaagtcccgcctgaacgccctcggcaagagcgagttccagatctacaagaagtccggcatccaggaggtggaccggaccctggcgaaggaggggatcaagcgcggcgagacggaccaccacgccgtgagccgggggtccgccaagctgcgctggttcgtcgagcggaacatggtgaccccggagggcaaggtggtcgacctcggctgcgggcgcggcgggtggagctactactgcggcgggctgaaggacgtgcgggaggtgaagggcctgaccaagggcgggcccggccacgaggagcccatccccatgtccacctacgggtggaacctcgtccgcctgcagagcggcatcgacgtgttcttcacgccgcccgagaagtgcgacaccctgctctgcgacatcggggagagctcccccaaccccaccatcgaggccggccggaccctgcgcgtgctgaacctcgtcgagaactggctgaacaacaacacccagttctgcatcaaggtgctgaacccgtacatgcccagcgtgatcgagaagatggagacgctccagcggaagtacggcggggccctggtccgcaaccccctgtcccggaacagcacccacgagatgtactgggtgtccaacgcgaccggcaacatcgtgagctccgtcaacatgatcagccgcatgctgatcaaccggttcaccatgaagcacaagaaggccacgtacgagccggacgtggacctcgggtccggcacccgcaacatcgggatcgagagcgagatccccaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtcccgatggtgacccagatggccatgacggacaccacccccttcgggcagcagcgcgtgttcaaggagaaggtcgacacccggacgcaggagcccaaggagggcaccaagaagctgatgaagatcaccgcggagtggctgtggaaggagctcggcaagaagaagacgccccggatgtgcacgcgggaggagttcacccgcaaggtgcggagcaacgccgccctgggggccatcttcaccgacgagaacaagtggaagtccgcccgcgaggcggtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggccatctggtacatgtggctcggggcccgcttcctggagttcgaggcgctgggcttcctcaacgaggaccactggttctcccgggggaacagcctgagcggcgtggagggggagggcctgcaccgcctcggctacatcctgcgggacgtcgggaagaaggagggcggggccatgtacgccgacgacacggccggctgggacacccgcatcaccctggaggacctcaagaacgaggagatggtgaccaaccacatgaagggggagcacaagaagctggccgaggcgatcttcaagctgacgtaccagaacaaggtcgtgcgggtgcagcgcccgacgccccggggcaccgtcatggacatcatctcccgccgggaccagcgcggcagcggccaggtgggcacctacgggctcaacacgttcaccaacatggaggcccagctgatccgccagatggagggcgagggcatcttcaagtccatccagcacctgaccgccaccgaggagatcgccgtgcagaactggctcgcccgggtcgggcgcgagcggctgagccgcatggcgatctccggcgacgactgcgtggtgaagcccatcgacgaccggttcgccagcgccctgacggccctcaacgacatggggaaggtccgcaaggacatccagcagtgggagccctcccggggctggaacgactggacccaggtgccgttctgcagccaccacttccacgagctggtgatgaaggacgggcgcgtcctggtggtgccctgccggaaccaggacgagctcatcggccgcgcccggatctcccagggcgcggggtggagcctgaaggagaccgcctgcctgggcaagtcctacgcccagatgtggaccctcatgtacttccaccgccgggacctgcgcctggccgccaacgcgatctgcagcgccgtcccctcccactgggtgcccaccagccggacgacctggtccatccacgccaagcacgagtggatgaccaccgaggacatgctcgccgtgtggaaccgcgtctggatccaggagaacccgtggatggaggacaagacgcccgtggagagctgggaggaggtgccctacctggggaagcgggaggaccagtggtgcggctccctgatcgggctcaccagccgcgcgacctgggccaagaacatccagaccgccatcaaccaggtccggagcctgatcggcaacgaggagtacacggactacatgccctccatgaagcgcttccgcaaggaggaggaggaggccggcgtgctgtggtga

SEQ ID NO: 9194 - RNA, 9876 nt, synthetic construct
  misc_feature 1..9876: note = derived and/or modified CDS sequence (opt1) from DENV-2__GQ868515__SS-prME
  source 1..9876: mol_type = other RNA
accgcgggcgtgatcgtcatgctgatccccaccgtgatggccttccacctcaccacccgcaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctggatcacctacgggacctgctccaccaccggcgagcaccggcgcgagaagcggagcgtggccctggtgccccacgtcgggatgggcctcgagacccgcaccgagacctggatgagcagcgagggggcctggaagcacgtgcagcggatcgagacctggatcctgcgccacccgggcttcaccatcatggccgccatcctggcgtacaccatcgggaccacccacttccagcgggccctcatcttcatcctgctgacggccgtggcccccagcatgaccatgcgctgcatcggcatcagcaaccgggacttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccgcaagtactgcatcgaggccaagctgaccaacacgaccaccgagagccggtgcccgacccagggcgagccctccctgaacgaggagcaggacaagcgcttcatctgcaagcacagcatggtggaccggggctgggggaacggctgcgggctgttcggcaagggcggcatcgtcacgtgcgccatgttcacgtgcaagaagaacatggagggcaaggtggtgcagcccgagaacctggagtacaccatcgtcatcacgccccactccggggaggagcacgcggtgggcaacgacacggggaagcacggcaaggagatcaagatcaccccgcagagctccatcaccgaggccgagctgaccgggtacggcaccgtgacgatggagtgcagcccccgcaccggcctcgacttcaacgagatggtcctgctgcagatggaggacaaggcctggctcgtgcaccggcagtggttcctggacctgcccctcccctggctgccgggggccgacacccagggctccaactggatccagaaggagaccctggtgacgttcaagaacccccacgccaagaagcaggacgtcgtggtcctcgggagccaggagggcgcgatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgccgagacccagcacgggaccatcgtgatccgcgtccggtacgagggcgacggcagcccctgcaagatccccttcgagatcacggactccgagaagcgccacgtgctggggcgcctcatcaccgtgaacccgatcgtcaccgagaaggacagccccgtgaacatcgaggccgagccgcccttcggcgactcctacatcatcatcggggtggagccgggccagctgaagctgaactggttcaagaaggggagctccatcggccagatgttcgagaccacgatgcggggcgcgaagcgcatggccatcctcggggacaccgcctgggacttcggcagcctcgggggcgtcttcacctccatcgggaaggccctgcaccaggtgttcggcgccatctacggcgcggccttcagcggggtgtcctggaccatgaagatcctcatcggcgtcatcatcacgtggatcgggatgaacagccggtccaccagcctgtccgtgagcctggtgctggtcggcgtggtgatcctctacctgggggccatggtccaggccgactccggctgcgtggtgagctggaagaacaaggagctgaagtgcggcagcgggatcttcatcaccgacaacgtccacacctggacggagcagtacaagttccagcccgagtcccccagcaagctcgcgtccgccatccagaaggcccacgaggagggcatctgcgggatccgcagcgtgacccggctggagaacctgatgtggaagcagatcacccccgagctcaaccacatcctgtccgagaacgaggtgaagctgaccatcatgacgggcgacatcaaggggatcatgcaggccggcaagcgcagcctccggccgcagcccaccgagctgaagtactcctggaagacctggggcaaggccaagatgctgagcaccgagtcccacaaccagacgttcctcatcgacgggcccgagaccgcggagtgcccgaacaccaaccgcgcctggaacagcctggaggtcgaggactacggcttcggggtgttcaccacgaacatctggctgaagctccgggagaagcaggacgtgttctgcgactccaagctgatgagcgccgccatcaaggacaaccgcgccgtccacgcggacatgggctactggatcgagtccgccctgaacgacacctggaagatggagaaggccagcttcatcgaggtgaagtcctgccactggcccaagagccacaccctctggtccaacggcgtgctggagagcgagatgatcatccccaagaacttcgccgggcccgtcagccagcacaactaccggccgggctaccacacccagaccgccgggccctggcacctgggcaagctcgagatggacttcgacctgtgcgaggggacgaccgtggtggtcaccgaggactgcggcaaccgcggcccctccctgcggaccacgaccgcgagcgggaagctcatcaccgagtggtgctgccgctcctgcaccctgcccccgctgcggtaccgcggcgaggacgggtgctggtacggcatggagatccggcccctcaaggagaaggaggagaacctggtgaacagcctggtgacggccgggcacggccagatcgacaacttctccctcggcgtcctggggatggccctgttcctcgaggagatgctgcgcacccggatcggcaccaagcacgccatcctgctcgtggcggccagcttcgtgaccctgatcacggggaacatgtccttccgcgacctgggccgcgtcatggtgatggtgggggccaccatgaccgacgacatcggcatgggcgtcacctacctcgccctgctggccgcgttcaaggtgcggcccacgttcgccgccgggctcctgctgcgcaagctcaccagcaaggagctgatgatggccaccatcggcatcgccctgctctcccagagcaccatccccgagtccatcctggagctgacggacgcgctcgccctggggatgatggtgctgaagatcgtccggaacatggagaagtaccagctcgccgtgaccatcatggccatcagctgcgtgccgaacgccgtcatcctgcagaacgcgtggaaggtgtcctgcaccatcctggccgccgtgagcgtcagccccctcctgctgaccagctcccagcagaaggccgactggatccccctcgcgctgacgatcaagggcctgaaccccaccgccatcttcctcaccaccctgagccgcacgtccaagaagcggagctggccgctgaacgaggccgtgatggccgtcggcatggtgagcatcctcgcctccagcctgctgaagaacgacatccccatgaccgggcccctcgtggcgggcgggctgctgaccgtctgctacgtgctcaccggccgctccgccgacctggagctggagcgggccgccgacgtgaagtgggaggaccaggccgagatcagcgggtccagccccatcctctccatcacgatcagcgaggacggctccatgagcatcaagaacgaggaggaggagcagaccctgaccatcctgatccgcaccggcctcctggtcatctccggggtgttcccggtgagcatccccatcacggcggccgcctggtacctgtgggaggtcaagaagcagcgggccggcgtgctctgggacgtgcccagcccgccgcccgtcgagaaggccgagctggaggacggggcgtaccgcatcaagcagcggggcatcctggggtacagccagatcggcgccggcgtgtacaaggaggggaccttccacaccatgtggcacgtgacccgcggcgccgtcctcatgcaccgggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggcggtgcagaccaagcccgggatcttcaagacgaacaccggcaccatcggggccgtgtccctggacttcagccccggcacctccggcagccccatcgtcgaccgcaaggggaaggtggtgggcctctacgggaacggcgtcgtgacgcggagcggcgcctacgtgtccgccatcgcgcagaccgagaagtccatcgaggacaaccccgagatcgaggacgacatcttccgcaagaagcggctgaccatcatggacctgcaccccggggccggcaagaccaagcgctacctccccgccatcgtccgggaggccatcaagcgcgggctgcgcacgctgatcctggccccgacccgggtggtggcggccgagatggaggaggccctccgcggcctgcccatccggtaccagacccccgccatcaagaccgagcacacggggcgcgagatcgtcgacctgatgtgccacgccaccttcaccatgcggctcctgtcccccgtgcgcgtgccgaactacaacctgatcatcatggacgaggcgcacttcaccgaccccgccagcatcgccgcccggggctacatctccacgcgcgtcgagatgggcgaggccgcggggatcttcatgaccgccacgccgcccggcagccgggacccgttcccccagtccaacgcccccatcatggacgaggagcgcgagatccccgagcggagctggaactccgggcacgagtgggtgaccgacttcaagggcaagacggtgtggttcgtcccgagcatcaaggccgggaacgacatcgcggcctgcctccgcaagaacggcaagaaggtgatccagctgtcccggaagaccttcgacagcgagtacgtgaagacccgcgccaacgactgggacttcgtcgtgaccacggacatctccgagatgggcgccaacttcaaggccgagcgggtgatcgacccccgccggtgcatgaagcccgtcatcctgaccgacggggaggagcgcgtgatcctcgcgggccccatgccggtgacccacagctccgccgcccagcggcgcgggcgcatcggccggaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgcgagaaggtcgacgcgatcgacggcgagtaccggctgcgcggggaggcccggaagacgttcgtggacctgatgcgccggggcgacctccccgtgtggctggcctacaaggtcgccgccgaggggatcaactacgcggaccgcaagtggtgcttcgacggcatcaagaacaaccagatcctggaggagaacatggaggtggagatctggaccaaggagggggagcggaagaagctcaagccgcgctggctggacgcccggatctactccgaccccctggccctcaaggagttcaaggagttcgccgcgggccgcaagagcctgaccctgaacctcatcaccgagatgggccggctgcccacgttcatgacccagaaggcccgcaacgccctggacaacctcgccgtgctgcacaccgccgaggccgggggccgggcctacaaccacgccctgtccgagctccccgagaccctggagacgctgctcctgctgaccctcctggccaccgtcaccgggggcatcttcctgttcctcatgagcggcaaggggatcggcaagatgacgctggggatgtgctgcatcatcaccgccagcatcctgctctggtacgcgcagatccagccgcactggatcgccgcctccatcatcctggagttcttcctgatcgtgctcctgatccccgagcccgagaagcagcgcacgccccaggacaaccagctgacctacgtcgtgatcgccatcctcaccgtggtcgccgcgacgatggccaacgagatgggcttcctggagaagaccaagaaggacctggggctcggcagcatcaccacccaggagtccgagagcaacatcctggacatcgacctgcggccggcctccgcctggacgctctacgccgtggcgaccaccttcgtgacccccatgctgcgccacagcatcgagaactccagcgtcaacgtgtccctgacggccatcgccaaccaggccaccgtgctcatgggcctggggaagggctggcccctgagcaagatggacatcggggtccccctcctggcgatcggctgctactcccaggtgaacccgatcaccctgaccgccgccctcctgctgctcgtggcccactacgccatcatcgggcccggcctgcaggcgaaggccacgcgggaggcccagaagcgcgccgccgcgggcatcatgaagaaccccaccgtcgacgggatcaccgtgatcgacctggagcccatcccgtacgaccccaagttcgagaagcagctcggccaggtgatgctgctgatcctctgcgtcacccaggtgctgatgatgcggacgacctgggccctgtgcgaggccctcaccctggccaccgggcccatcagcacgctgtgggagggcaaccccgggcgcttctggaacaccaccatcgccgtgtccatggcgaacatcttccgcggcagctacctcgccggcgccgggctgctgttctccatcatgaagaacaccacgaacacccggcgcggcaccgggaacatcggcgagaccctcggcgagaagtggaagtcccggctgaacgccctggggaagtccgagttccagatctacaagaagtccggcatccaggaggtcgaccgcacgctcgcgaaggaggggatcaagcggggcgagaccgaccaccacgccgtgtcccgcgggagcgccaagctgcggtggttcgtggagcgcaacatggtcaccccggagggcaaggtggtggacctgggctgcgggcggggcgggtggagctactactgcggcgggctcaaggacgtccgcgaggtgaagggcctgaccaagggcgggcccggccacgaggagcccatccccatgtccacgtacgggtggaacctggtgcggctccagagcggcatcgacgtcttcttcaccccgcccgagaagtgcgacaccctgctgtgcgacatcggggagtccagccccaaccccaccatcgaggccggccgcacgctccgggtgctgaacctggtggagaactggctcaacaacaacacccagttctgcatcaaggtcctgaacccgtacatgccctccgtgatcgagaagatggagaccctgcagcgcaagtacggcggggccctcgtgcggaaccccctgagccgcaactccacccacgagatgtactgggtcagcaacgcgaccggcaacatcgtgtccagcgtgaacatgatctcccggatgctgatcaaccgcttcacgatgaagcacaagaaggccacctacgagccggacgtcgacctggggagcggcacccggaacatcgggatcgagtccgagatccccaacctcgacatcatcggcaagcgcatcgagaagatcaagcaggagcacgagaccagctggcactacgaccaggaccacccctacaagacgtgggcctaccacggctcctacgagaccaagcagaccgggagcgcctccagcatggtgaacggcgtggtccgcctgctgaccaagccctgggacgtggtgccgatggtcacgcagatggccatgaccgacaccacccccttcgggcagcagcgggtgttcaaggagaaggtggacacgcgcacccaggagcccaaggagggcaccaagaagctcatgaagatcaccgcggagtggctgtggaaggagctgggcaagaagaagacgccccggatgtgcacccgcgaggagttcacccggaaggtccgctccaacgccgccctcggggccatcttcaccgacgagaacaagtggaagtccgcccgggaggcggtggaggacggccgcttctgggagctggtggaccgggagcgcaacctgcacctcgaggggaagtgcgagacgtgcgtctacaacatgatgggcaagcgggagaagaagctgggggagttcggcaaggccaagggcagccgcgccatctggtacatgtggctgggggcccggttcctcgagttcgaggcgctgggcttcctgaacgaggaccactggttctcccgcgggaacagcctctccggcgtggagggggagggcctgcaccggctgggctacatcctccgcgacgtggggaagaaggagggcggggccatgtacgccgacgacaccgccggctgggacacccggatcaccctggaggacctgaagaacgaggagatggtcacgaaccacatgaagggggagcacaagaagctcgccgaggcgatcttcaagctgacctaccagaacaaggtggtccgcgtgcagcggccgacgccccgcggcaccgtgatggacatcatcagccggcgcgaccagcgcggctccgggcaggtcggcacgtacgggctgaacaccttcaccaacatggaggcccagctcatccggcagatggagggcgagggcatcttcaagaacatccagcacctgaccgccacggaggagatcgccgtgcagaactggctggcccgcgtggggcgggagcgcctcagccggatggcgatctccggcgacgactgcgtcgtgaagcccatcgacgaccgcttcgccagcgccctgaccgccctgaacgacatggggaaggtgcggaaggacatccagcagtgggagccctcccgcggctggaacgactggacccaggtcccgttctgcagccaccacttccacgagctcgtgatgaaggacgggcgggtgctggtcgtgccctgccgcaaccaggacgagctgatcggccgggcccgcatctcccagggcgcggggtggagcctcaaggagaccgcctgcctgggcaagtcctacgcccagatgtggacgctgatgtacttccaccggcgcgacctccggctggccgccaacgcgatctgcagcgccgtgccctcccactgggtccccaccagccgcaccacctggtccatccacgccaagcacgagtggatgaccacggaggacatgctggccgtgtggaaccgggtgtggatccaggagaacccgtggatggaggacaagacccccgtcgagagctgggaggaggtgccctacctcgggaagcgcgaggaccagtggtgcggcagcctgatcgggctgacctcccgggcgacctgggccaagaacatccagacggccatcaaccaggtgcgcagcctcatcggcaacgaggagtacaccgactacatgccctccatgaagcgcttccggaaggaggaggaggaggccggcgtcctgtggtga

SEQ ID NO: 9195 - RNA, 9876 nt, synthetic construct
  misc_feature 1..9876: note = derived and/or modified CDS sequence (opt1) from DENV-2__GQ868516__SS-prME
  source 1..9876: mol_type = other RNA
accgcgggcgtgatcgtcatgctgatccccaccgtgatggccttccacctcaccacccggaacggggagccccacatgatcgtgggccggcaggagaagggcaagagcctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaactccaccagcacctggatcacctacgggacctgctccaccaccggcgagcaccggcgcgagaagcggagcgtggccctggtgccccacgtcgggatgggcctcgagacccgcaccgagacctggatgtccagcgagggggcctggaagcacgtgcagcggatcgagacctggatcctgcgccacccgggcttcaccatcatggccgccatcctggcgtacaccatcgggaccacccacttccagcgggccctcatcttcatcctgctgacggccgtggccccctccatgaccatgcgctgcatcggcatcagcaaccgggacttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccgcaagtactgcatcgaggccaagctgaccaacacgaccaccgagagccggtgcccgacccagggcgagccctccctgaacgaggagcaggacaagcgcttcatctgcaagcacagcatggtggaccggggctgggggaacggctgcgggctgttcggcaagggcgggatcgtcacgtgcgccatgttcacgtgcaagaagaacatggagggcaaggtggtgcagcccgagaacctggagtacaccatcgtcatcacgccccactccggggaggagcacgcggtgggcaacgacacggggaagcacggcaaggagatcaagatcaccccgcagagctccatcaccgaggccgagctgaccgggtacggcaccgtgacgatggagtgcagcccccgcaccggcctcgacttcaacgagatggtcctgctgcagatggaggacaaggcctggctcgtgcaccggcagtggttcctggacctgcccctcccctggctgccgggggccgacacccagggctccaactggatccagaaggagaccctggtgacgttcaagaacccccacgccaagaagcaggacgtcgtggtcctcgggagccaggagggcgcgatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgccgagacccagcacgggaccatcgtgatccgcgtccagtacgagggcgacggcagcccctgcaagatccccttcgagatcacggacctggagaagcggcacgtgctcgggcgcctgatcaccgtgaacccgatcgtcaccgagaaggactcccccgtgaacatcgaggccgagccgcccttcggcgacagctacatcatcatcggggtggagccgggccagctgaagctcaactggttcaagaaggggtccagcatcggccagatgttcgagaccacgatgcgcggcgcgaagcggatggccatcctgggggacaccgcctgggacttcggctccctcggcggggtcttcaccagcatcgggaaggccctccaccaggtgttcggggccatctacggcgcggccttctccggggtgagctggaccatgaagatcctgatcggcgtcatcatcacgtggatcgggatgaactcccgcagcacctccctgagcgtgtccctggtgctcgtcggcgtggtgatcctgtacctgggggccatggtccaggccgacagcggctgcgtggtgtcctggaagaacaaggagctcaagtgcggcagcgggatcttcatcaccgacaacgtccacacctggacggagcagtacaagttccagcccgagagcccctccaagctggcgagcgccatccagaaggcccacgaggagggcatctgcgggatccggtccgtgacccgcctggagaacctcatgtggaagcagatcacccccgagctgaaccacatcctgagcgagaacgaggtgaagctcaccatcatgacgggcgacatcaaggggatcatgcaggccggcaagcggtccctgcgcccgcagcccaccgagctgaagtacagctggaagacctggggcaaggccaagatgctctccaccgagagccacaaccagacgttcctgatcgacgggcccgagaccgcggagtgcccgaacaccaaccgggcctggaactccctggaggtcgaggactacggcttcggggtgttcaccacgaacatctggctcaagctgcgcgagaagcaggacgtgttctgcgacagcaagctgatgtccgccgccatcaaggacaaccgggccgtccacgcggacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacccagaccgccgggccctggcacctcggcaagctggagatggacttcgacctgtgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcatcggcaccaagcacgccatcctcctggtggcggcctccttcgtgaccctgatcacggggaacatgagcttccgggacctcggccgcgtcatggtgatggtgggggccaccatgaccgacgacatcggcatgggcgtcacctacctggccctgctcgccgcgttcaaggtgcgccccacgttcgccgccgggctgctgctccggaagctgacctccaaggagctgatgatggccaccatcggcatcgccctcctgagccagtccaccatccccgagagcatcctggagctcacggacgcgctggccctggggatgatggtgctcaagatcgtccgcaacatggagaagtaccagctggccgtgaccatcatggccatctcctgcgtgccgaacgccgtcatcctgcagaacgcgtggaaggtgagctgcaccatcctcgccgccgtgtccgtcagccccctgctgctcacctccagccagcagaaggccgactggatccccctggcgctgacgatcaagggcctcaaccccaccgccatcttcctgaccaccctgtcccggacgagcaagaagcgctcctggccgctcaacgaggccgtgatggccgtcggcatggtgagcatcctggccagctccctgctcaagaacgacatccccatgaccgggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcacgatctccgaggacggcagcatgtccatcaagaacgaggaggaggagcagaccctgaccatcctcatccggaccggcctgctggtcatcagcggggtgttcccggtgtccatccccatcacggcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacaccatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagacgaacaccggcaccatcggggccgtgagcctcgacttctcccccggcaccagcggctcccccatcgtcgaccggaaggggaaggtggtgggcctgtacgggaacggcgtcgtgacgcgcagcggcgcctacgtgagcgccatcgcgcagaccgagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcacgctgatcctcgccccgacccgcgtggtggcggccgagatggaggaggccctgcggggcctgcccatccgctaccagacccccgccatcaagaccgagcacacggggcgggagatcgtcgacctcatgtgccacgccaccttcaccatgcgcctgctgagccccgtgcgggtgccgaactacaacctcatcatcatggacgaggcgcacttcaccgaccccgcctccatcgccgcccgcggctacatcagcacgcgggtcgagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagacggtgtggttcgtcccgtccatcaaggccgggaacgacatcgcggcctgcctgcggaagaacggcaagaaggtgatccagctgagccgcaagaccttcgactccgagtacgtgaagacccgggccaacgactgggacttcgtcgtgaccacggacatcagcgagatgggcgccaacttcaaggccgagcgcgtgatcgacccccggcgctgcatgaagcccgtcatcctcaccgacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagacgttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggaccaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccacgttcatgacccagaaggcccggaacgccctcgacaacctggccgtgctgcacaccgccgaggccgggggccgcgcctacaaccacgccctcagcgagctgcccgagaccctggagacgctcctgctgctcaccctgctggccaccgtcaccgggggcatcttcctcttcctgatgtccggcaaggggatcggcaagatgacgctggggatgtgctgcatcatcaccgccagcatcctcctgtggtacgcgcagatccagccgcactggatcgccgccagcatcatcctggagttcttcctcatcgtgctgctgatccccgagcccgagaagcagcggacgccccaggacaaccagctcacctacgtcgtgatcgccatcctgaccgtggtcgccgcgacgatggccaacgagatgggcttcctggagaagaccaagaaggacctcgggctgggctccatcaccacccaggagagcgagtccaacatcctggacatcgacctccgcccggccagcgcctggacgctgtacgccgtggcgaccaccttcgtgacccccatgctgcggcactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacgcgcgaggcccagaagcgggccgccgcgggcatcatgaagaaccccaccgtcgacgggatcaccgtgatcgacctcgagcccatcccgtacgaccccaagttcgagaagcagctgggccaggtgatgctgctcatcctgtgcgtcacccaggtgctgatgatgcgcacgacctgggccctctgcgaggccctgaccctggccaccgggcccatctccacgctctgggagggcaaccccgggcggttctggaacaccaccatcgccgtgagcatggcgaacatcttccgcggctcctacctggccggcgccgggctcctgttcagcatcatgaagaacaccacgaacacccgccggggcaccgggaacatcggcgagaccctgggcgagaagtggaagtcccgcctgaacgccctcggcaagagcgagttccagatctacaagaagtccggcatccaggaggtcgaccggacgctggcgaaggaggggatcaagcgcggcgagaccgaccaccacgccgtgagccgggggtccgccaagctgcgctggttcgtggagcggaacatggtcaccccggagggcaaggtggtggacctcggctgcgggcgcggcgggtggagctactactgcggcgggctgaaggacgtccgggaggtgaagggcctgaccaagggcgggcccggccacgaggagcccatccccatgagcacgtacgggtggaacctcgtgcgcctgcagtccggcatcgacgtcttcttcaccccgcccgagaagtgcgacaccctgctctgcgacatcggggagagctcccccaaccccaccatcgaggccggccggacgctgcgcgtgctgaacctcgtggagaactggctgaacaacaacacccagttctgcatcaaggtcctgaacccgtacatgcccagcgtgatcgagaagatggagaccctccagcggaagtacggcggggccctggtgcgcaaccccctgtcccggaacagcacccacgagatgtactgggtctccaacgcgaccggcaacatcgtgagctccgtgaacatgatcagccgcatgctgatcaaccggttcacgatgaagcacaagaaggccacctacgagccggacgtcgacctcgggtccggcacccgcaacatcgggatcgagagcgagatccccaacctggacatcatcggcaagcggatcgagaagatcaagcaggagcacgagacctcctggcactacgaccaggaccacccctacaagacgtgggcctaccacggcagctacgagaccaagcagaccgggtccgccagctccatggtgaacggcgtggtccgcctgctcaccaagccctgggacgtggtgccgatggtcacgcagatggccatgaccgacaccacccccttcgggcagcagcgcgtgttcaaggagaaggtggacacgcggacccaggagcccaaggagggcaccaagaagctgatgaagatcaccgcggagtggctgtggaaggagctcggcaagaagaagacgccccgcatgtgcacccgggaggagttcacccgcaaggtccggagcaacgccgccctgggggccatcttcaccgacgagaacaagtggaagtccgcccgcgaggcggtggaggacggccggttctgggagctggtggaccgcgagcggaacctccacctggaggggaagtgcgagacgtgcgtctacaacatgatgggcaagcgcgagaagaagctgggggagttcggcaaggccaagggcagccgggccatctggtacatgtggctcggggcccgcttcctggagttcgaggcgctgggcttcctcaacgaggaccactggttcagccgggggaactccctgagcggcgtggagggggagggcctgcaccgcctcggctacatcctgcgggacgtggggaagaaggagggcggggccatgtacgccgacgacaccgccggctgggacacccgcatcaccctggaggacctcaagaacgaggagatggtcacgaaccacatgaagggggagcacaagaagctggccgaggcgatcttcaagctgacctaccagaacaaggtggtccgggtgcagcgcccgacgccccggggcaccgtgatggacatcatctcccgccgggaccagcgcggcagcgggcaggtcggcacgtacgggctcaacaccttcaccaacatggaggcccagctgatccgccagatggagggcgagggcatcttcaagaacatccagcacctgaccgccacggaggagatcgccgtgcagaactggctcgcccgggtggggcgcgagcggctgtcccgcatggcgatcagcggcgacgactgcgtcgtgaagcccatcgacgaccggttcgcctccgccctgaccgccctcaacgacatggggaaggtgcgcaaggacatccagcagtgggagcccagccggggctggaacgactggacccaggtcccgttctgctcccaccacttccacgagctggtgatgaaggacgggcgcgtgctggtcgtgccctgccggaaccaggacgagctcatcggccgcgcccggatcagccagggcgcggggtggtccctgaaggagaccgcctgcctgggcaagagctacgcccagatgtggacgctcatgtacttccaccgccgggacctgcgcctggccgccaacgcgatctgctccgccgtgcccagccactgggtccccacctcccggaccacctggagcatccacgccaagcacgagtggatgaccacggaggacatgctcgccgtgtggaaccgcgtgtggatccaggagaacccgtggatggaggacaagacccccgtcgagtcctgggaggaggtgccctacctggggaagcgggaggaccagtggtgcggcagcctgatcgggctcaccagccgcgcgacctgggccaagaacatccagacggccatcaaccaggtgcggtccctgatcggcaacgaggagtacaccgactacatgcccagcatgaagcgcttccgcaaggaggaggaggaggccggcgtcctgtggtga

SEQ ID NO: 9196 - RNA, 9876 nt, synthetic construct
  misc_feature 1..9876: note = derived and/or modified CDS sequence (opt1) from DENV-2__GU131975__SS-prME
  source 1..9876: mol_type = other RNA
accgcgggcgtgatcgtcatgctgatccccaccgtgatggccttccacctcaccacccggaacggggagccccacatgatcgtgggccggcaggagaagggcaagagcctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaactccaccagcacctggatcacctacgggacctgctccaccaccggcgagcaccggcgcgagaagcggagcgtggccctggtgccccacgtcgggatgggcctcgagacccgcaccgagacctggatgtccagcgagggggcctggaagcacgtgcagcggatcgagacctggatcctgcgccacccgggcttcaccatcatggccgccatcctggcgtacaccatcgggaccacccacttccagcgggccctcatcttcatcctgctgacggccgtggccccctccatgaccatgcgctgcatcggcatcagcaaccgggacttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccgcaagtactgcatcgaggccaagctgaccaacacgaccaccgagagccggtgcccgacccagggcgagccctccctgaacgaggagcaggacaagcgcttcatctgcaagcacagcatggtggaccggggctgggggaacggctgcgggctgttcggcaagggcgggatcgtcacgtgcgccatgttcacgtgcaagaagaacatggagggcaaggtggtgcagcccgagaacctggagtacaccatcgtcatcacgccccactccggggaggagcacgcggtgggcaacgacacggggaagcacggcaaggagatcaagatcaccccgcagagctccatcaccgaggccgagctgaccgggtacggcaccgtgacgatggagtgcagcccccgcaccggcctcgacttcaacgagatggtcctgctgcagatggaggacaaggcctggctcgtgcaccggcagtggttcctggacctgcccctcccctggctgccgggggccgacacccagggctccaactggatccagaaggagaccctggtgacgttcaagaacccccacgccaagaagcaggacgtcgtggtcctcgggagccaggagggcgcgatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgccgagacccagcacgggaccatcgtgatccgcgtccagtacgagggcgacggcagcccctgcaagatccccttcgagatcacggacctggagaagcggcacgtgctcgggcgcctgatcaccgtgaacccgatcgtcaccgagaaggactcccccgtgaacatcgaggccgagccgcccttcggcgacagctacatcatcatcggggtggagccgggccagctgaagctcaactggttcaagaaggggtccagcatcggccagatgttcgagaccacgatgcgcggcgcgaagcggatggccatcctgggggacaccgcctgggacttcggctccctcggcggggtcttcaccagcatcgggaaggccctccaccaggtgttcggggccatctacggcgcggccttctccggggtgagctggaccatgaagatcctgatcggcgtcatcatcacgtggatcgggatgaactcccgcagcacctccctgagcgtgtccctggtgctcgtcggcgtggtgatcctgtacctgggggccatggtccaggccgacagcggctgcgtggtgtcctggaagaacaaggagctcaagtgcggcagcgggatcttcatcaccgacaacgtccacacctggacggagcagtacaagttccagcccgagagcccctccaagctggcgagcgccatccagaaggcccacgaggagggcatctgcgggatccggtccgtgacccgcctggagaacctcatgtggaagcagatcacccccgagctgaaccacatcctgagcgagaacgaggtgaagctcaccatcatgacgggcgacatcaaggggatcatgcaggccggcaagcggtccctgcgcccgcagcccaccgagctgaagtacagctggaagacctggggcaaggccaagatgctctccaccgagagccacaaccagacgttcctgatcgacgggcccgagaccgcggagtgcccgaacaccaaccgggcctggaactccctggaggtcgaggactacggcttcggggtgttcaccacgaacatctggctcaagctgcgcgagaagcaggacgtgttctgcgacagcaagctgatgtccgccgccatcaaggacaaccgggccgtccacgcggacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacccagaccgccgggccctggcacctcggcaagctggagatggacttcgacctgtgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcatcggcaccaagcacgccatcctcctggtggcggcctccttcgtgaccctgatcacggggaacatgagcttccgggacctcggccgcgtcatggtgatggtgggggccaccatgaccgacgacatcggcatgggcgtcacctacctggccctgctcgccgcgttcaaggtgcgccccacgttcgccgccgggctgctgctccggaagctgacctccaaggagctgatgatggccaccatcggcatcgccctcctgagccagtccaccatccccgagagcatcctggagctcacggacgcgctggccctggggatgatggtgctcaagatcgtccgcaacatggagaagtaccagctggccgtgaccatcatggccatctcctgcgtgccgaacgccgtcatcctgcagaacgcgtggaaggtgagctgcaccatcctcgccgccgtgtccgtcagccccctgctgctcacctccagccagcagaaggccgactggatccccctggcgctgacgatcaagggcctcaaccccaccgccatcttcctgaccaccctgtcccggacgagcaagaagcgctcctggccgctcaacgaggccgtgatggccgtcggcatggtgagcatcctggccagctccctgctcaagaacgacatccccatgaccgggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcacgatctccgaggacggcagcatgtccatcaagaacgaggaggaggagcagaccctgaccatcctcatccggaccggcctgctggtcatcagcggggtgttcccggtgtccatccccatcacggcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacaccatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagacgaacaccggcaccatcggggccgtgagcctcgacttctcccccggcaccagcggctcccccatcgtcgaccggaaggggaaggtggtgggcctgtacgggaacggcgtcgtgacgcgcagcggcgcctacgtgagcgccatcgcgcagaccgagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcacgctgatcctcgccccgacccgcgtggtggcggccgagatggaggaggccctgcggggcctgcccatccgctaccagacccccgccatcaagaccgagcacacggggcgggagatcgtcgacctcatgtgccacgccaccttcaccatgcgcctgctgagccccgtgcgggtgccgaactacaacctcatcatcatggacgaggcgcacttcaccgaccccgcctccatcgccgcccgcggctacatcagcacgcgggtcgagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagacggtgtggttcgtcccgtccatcaaggccgggaacgacatcgcggcctgcctgcggaagaacggcaagaaggtgatccagctgagccgcaagaccttcgactccgagtacgtgaagacccgggccaacgactgggacttcgtcgtgaccacggacatcagcgagatgggcgccaacttcaaggccgagcgcgtgatcgacccccggcgctgcatgaagcccgtcatcctcaccgacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagacgttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggaccaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccacgttcatgacccagaaggcccggaacgccctcgacaacctggccgtgctgcacaccgccgaggccgggggccgcgcctacaaccacgccctcagcgagctgcccgagaccctggagacgctcctgctgctcaccctgctggccaccgtcaccgggggcatcttcctcttcctgatgtccggcaaggggatcggcaagatgacgctggggatgtgctgcatcatcaccgccagcatcctcctgtggtacgcgcagatccagccgcactggatcgccgccagcatcatcctggagttcttcctcatcgtgctgctgatccccgagcccgagaagcagcggacgccccaggacaaccagctcacctacgtcgtgatcgccatcctgaccgtggtcgccgcgacgatggccaacgagatgggcttcctggagaagaccaagaaggacctcgggctgggctccatcaccacccaggagagcgagtccaacatcctggacatcgacctccgcccggccagcgcctggacgctgtacgccgtggcgaccaccttcgtgacccccatgctgcggcactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacgcgcgaggcccagaagcgggccgccgcgggcatcatgaagaaccccaccgtcgacgggatcaccgtgatcgacctcgagcccatcccgtacgaccccaagttcgagaagcagctgggccaggtgatgctgctcatcctgtgcgtcacccaggtgctgatgatgcgcacgacctgggccctctgcgaggccctgaccctggccaccgggcccatctccacgctctgggagggcaaccccgggcggttctggaacaccaccatcgccgtgagcatggcgaacatcttccgcggctcctacctggccggcgccgggctcctgttcagcatcatgaagaacaccacgaacacccgccggggcaccgggaacatcggcgagaccctgggcgagaagtggaagtcccgcctgaacgccctcggcaagagcgagttccagatctacaagaagtccggcatccaggaggtcgaccggacgctggcgaaggaggggatcaagcgcggcgagaccgaccaccacgccgtgagccgggggtccgccaagctgcgctggttcgtggagcggaacatggtcaccccggagggcaaggtggtggacctcggctgcgggcgcggcgggtggagctactactgcggcgggctgaaggacgtccgggaggtgaagggcctgaccaagggcgggcccggccacgaggagcccatccccatgagcacgtacgggtggaacctcgtgcgcctgcagtccggcatcgacgtcttcttcaccccgcccgagaagtgcgacaccctgctctgcgacatcggggagagctcccccaaccccaccatcgaggccggccggacgctgcgcgtgctgaacctcgtggagaactggctgaacaacaacacccagttctgcatcaaggtcctgaacccgtacatgcccagcgtgatcgagaagatggagaccctccagcggaagtacggcggggccctggtgcgcaaccccctgtcccggaacagcacccacgagatgtactgggtctccaacgcgaccggcaacatcgtgagctccgtgaacatgatcagccgcatgctgatcaaccggttcacgatgaagcacaagaaggccacctacgagccggacgtcgacctcgggtccggcacccgcaacatcgggatcgagagcgagatccccaacctggacatcatcggcaagcggatcgagaagatcaagcaggagcacgagacctcctggcactacgaccaggaccacccctacaagacgtgggcctaccacggcagctacgagaccaagcagaccgggtccgccagctccatggtgaacggcgtggtccgcctgctcaccaagccctgggacgtggtgccgatggtcacgcagatggccatgaccgacaccacccccttcgggcagcagcgcgtgttcaaggagaaggtggacacgcggacccaggagcccaaggagggcaccaagaagctgatgaagatcaccgcggagtggctgtggaaggagctcggcaagaagaagacgccccgcatgtgcacccgggaggagttcacccgcaaggtccggagcaacgccgccctgggggccatcttcaccgacgagaacaagtggaagtccgcccgcgaggcggtggaggacggccggttctgggagctggtggaccgcgagcggagcctccacctggaggggaagtgcgagacgtgcgtctacaacatgatgggcaagcgcgagaagaagctgggggagttcggcaaggccaagggcagccgggccatctggtacatgtggctcggggcccgcttcctggagttcgaggcgctgggcttcctcaacgaggaccactggttctcccgggggaacagcctgtccggcgtggagggggagggcctgcaccgcctcggctacatcctgcgggacgtggggaagaaggagggcggggccatgtacgccgacgacaccgccggctgggacacccgcatcaccctggaggacctcaagaacgaggagatggtcacgaaccacatgaagggggagcacaagaagctggccgaggcgatcttcaagctgacctaccagaacaaggtggtccgggtgcagcgcccgacgccccggggcaccgtgatggacatcatcagccgccgggaccagcgcggctccgggcaggtcggcacgtacgggctcaacaccttcaccaacatggaggcccagctgatccgccagatggagggcgagggcatcttcaagaacatccagcacctgaccgccacggaggagatcgccgtgcagaactggctcgcccgggtggggcgcgagcggctgagccgcatggcgatctccggcgacgactgcgtcgtgaagcccatcgacgaccggttcgccagcgccctgaccgccctcaacgacatggggaaggtgcgcaaggacatccagcagtgggagccctcccggggctggaacgactggacccaggtcccgttctgcagccaccacttccacgagctggtgatgaaggacgggcgcgtgctggtcgtgccctgccggaaccaggacgagctcatcggccgcgcccggatctcccagggcgcggggtggagcctgaaggagaccgcctgcctgggcaagtcctacgcccagatgtggacgctcatgtacttccaccgccgggacctgcgcctggccgccaacgcgatctgcagcgccgtgccctcccactgggtccccaccagccggaccacctggtccatccacgccaagcacgagtggatgaccacggaggacatgctcgccgtgtggaaccgcgtgtggatccaggagaacccgtggatggaggacaagacccccgtcgagagctgggaggaggtgccctacctggggaagcgggaggaccagtggtgcggcagcctgatcgggctcacctcccgcgcgacctgggccaagaacatccagacggccatcaaccaggtgcggagcctgatcggcaacgaggagtacaccgactacatgccctccatgaagcgcttccgcaaggaggaggaggaggccggcgtcctgtggtga

SEQ ID NO: 9197 - RNA, 9876 nt, synthetic construct
  misc_feature 1..9876: note = derived and/or modified CDS sequence (opt1) from DENV-2__JN819422__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagaaggccctcatcttcatcctgctgaccgccgtggcgcccagcatgaccatgcggtgcatcggcatctccaaccgcgacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccggaagtactgcatcgaggccaagctgacgaacaccaccaccgagtcccgctgccccacgcagggcgagcccagcctgaacgaggagcaggacaagcggttcatctgcaagcactccatggtggaccgcggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccgccagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcgcatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccggtccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgggtgatggtgatggtcggggccaccatgacggacgacatcggcatgggcgtgacctacctggccctgctcgccgcgttcaaggtgcgccccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcggaccctgatcctcgccccgacgcgcgtggtggcggccgagatggaggaggccctgcgcggcctgcccatccggtaccagacccccgccatcaagacccagcacaccgggcgcgagatcgtcgacctcatgtgccacgccacgttcaccatgcggctgctgagccccgtgcgcgtgccgaactacaacctcatcatcatggacgaggcgcacttcaccgaccccgcctccatcgccgcccggggctacatcagcacccgcgtcgagatgggcgaggccgcggggatcttcatgacggccacgccgcccggctcccgggacccgttcccccagagcaacgcccccatcatggacgaggagcgcgagatccccgagcggtcctggaacagcgggcacgagtgggtgaccgacttcaagggcaagaccgtgtggttcgtcccgtccatcaaggccgggaacgacatcgcggcctgcctgcgcaagaacggcaagaaggtgatccagctgagccggaagacgttcgactccgagtacgtgaagacccgcgccaacgactgggacttcgtcgtgaccaccgacatcagcgagatgggcgccaacttcaaggccgagcgggtgatcgacccccgccggtgcatgaagcccgtcatcctcacggacggggaggagcgcgtgatcctggcgggccccatgccggtgacccactccagcgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtcgacgcgatcgacggcgagtaccggctgcgcggggaggcccggaagaccttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatcgaggtggagatctggacgaaggagggggagcggaagaagctgaagccgcgctggctggacgcccggatctacagcgaccccctcgccctgaaggagttcaaggagttcgccgcgggccgcaagtccctgaccctcaacctgatcaccgagatgggccggctgcccaccttcatgacgcagaaggcccgcaacgccctcgacaacctggccgtgctgcacaccgccgaggccgggggccgggcctacaaccacgccctcagcgagctgcccgagaccctggagaccctcctgctgctcacgctgctggccaccgtcaccgggggcatcttcctcttcctgatgtccggcaagggggtgggcaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcgcacgccccaggacaaccagctcacctacgtggtgatcgccatcctgaccgtcgtggccgcgaccatggccaacgagatgggcttcctggagaagacgaagaaggacctcgggctgggcagcatcaccacccaggagagcgagtccaacatcctggacatcgacctccggccggccagcgcctggaccctgtacgccgtggcgacgaccttcgtcacccccatgctgcgccactccatcgagaacagctccgtgaacgtgagcctcaccgccatcgccaaccaggccacggtcctgatgggcctggggaagggctggcccctctccaagatggacatcggggtgcccctgctggcgatcggctgctacagccaggtgaacccgatcaccctcaccgccgccctgctgctcctggtcgcccactacgccatcatcgggcccggcctgcaggcgaaggccacccgggaggcccagaagcgcgccgccgcgggcatcatgaagaaccccacggtggacgggatcaccgtgatcgacctcgagcccatcccgtacgaccccaagttcgagaagcagctgggccaggtcatgctgctcatcctgtgcgtgacccaggtgctgatgatgcggaccacgtgggccctctgcgaggccctgaccctggccaccgggcccatctccaccctctgggagggcaaccccgggcgcttctggaacacgaccatcgccgtcagcatggcgaacatcttccggggctcctacctggccggcgccgggctcctgttcagcatcatgaagaacaccaccaacacgcgccgcggcaccgggaacatcggcgagaccctgggcgagaagtggaagtcccggctgaacgccctcggcaagagcgagttccaggtgtacaagaagtccggcatccaggaggtggaccgcaccctggcgaaggaggggatcaagcggggcgagacggaccaccacgccgtcagccgcgggtccgccaagctgcggtggttcgtggagcgcaacatggtgaccccggagggcaaggtcgtggacctcggctgcgggcggggcgggtggagctactactgcggcgggctgaagaacgtgcgcgaggtcaagggcctgaccaagggcgggcccggccacgaggagcccatccccatgtccacctacgggtggaacctcgtgcggctgcagagcggcgtggacgtcttcttcacgccgcccgagaagtgcgacaccctgctctgcgacatcggggagagctcccccaaccccaccatcgaggccggccgcaccctgcgggtgctgaacctcgtggagaactggctgaacaacaacacccagttctgcatcaaggtcctgaacccgtacatgcccagcgtgatcgagaagatggaggccctccagcgcaagtacggcggggcgctggtgcggaaccccctgtcccgcaacagcacgcacgagatgtactgggtctccaacgccaccggcaacatcgtgagctccgtgaacatgatcagccggatgctgatcaaccgcttcaccatgaagcacaagaaggccacctacgagccggacgtcgacctcgggtccggcacgcggaacatcgggatcgagagcgagatccccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccggctgctcaccaagccctgggacgtggtgccgatggtcacccagatggcgatgaccgacacgacccccttcgggcagcagcgcgtgttcaaggagaaggtggacacccgcacccaggagcccaaggagggcacgaagaagctgatgaagatcaccgccgagtggctgtggaaggagctcggcaagaagaagacgccccggatgtgcacccgcgaggagttcacgcggaaggtccgcagcaacgccgccctgggggccatcttcaccgacgagaacaagtggaagtccgcgcgggaggccgtggaggacggccgcttctgggagctggtggaccgggagcgcaacctccacctggaggggaagtgcgagacctgcgtctacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacaccgccggctgggacacgcggatcaccctggaggacctcaagaacgaggagatggtgaccaaccacatgaagggggagcacaagaagctggcggaggccatcttcaagctgacctaccagaacaaggtggtccgcgtgcagcggccgacgccccgcggcaccgtgatggacatcatctcccggcgcgaccagcggggcagcgggcaggtcggcacctacgggctcaacaccttcacgaacatggaggcccagctgatccgccagatggagggcgagggcatcttcaagtccatccagcacctgaccgccaccgaggagatcgccgtgcagaactggctcgcgcgcgtggggcgggagcgcctgagccggatggccatctccggcgacgactgcgtcgtgaagcccatcgacgaccgcttcgccagcgccctgaccgccctcaacgacatggggaaggtgcggaaggacatccagcagtgggagccctcccgcggctggaacgactggacgcaggtcccgttctgcagccaccacttccacgagctggtgatgaaggacgggcgggtgctggtcgtgccctgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtgccgccccactgggtcccgacctcccgcaccacgtggagcatccacgccaagcacgagtggatgaccaccgaggacatgctcgcggtgtggaaccgggtgtggatccaggagaacccctggatggaggacaagacccccgtcgagtcctgggaggaggtgccctacctggggaagcgcgaggaccagtggtgcggcagcctgatcgggctcacgtcccgggccacctgggccaagaacatccagaccgccatcaaccaggtgcgcagcctgatcggcaacgaggagtacaccgactacatgccgagcatgaagcggttccgccgcgaggaggaggaggccggcgtcctgtggtga

SEQ ID NO: 9198 - RNA, 9876 nt, synthetic construct
  misc_feature 1..9876: note = derived and/or modified CDS sequence (opt1) from DENV-2__GU131955__SS-prME
  source 1..9876: mol_type = other RNA
accgcgggcgtgatcgtcatgctgatccccaccgtgatggccttccacctcaccacccggaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctgggtgacctacgggacctgctccaccaccggcgagcaccggcgcgagaagcggagcgtggccctggtcccccacgtggggatgggcctcgagacgcgcaccgagacctggatgagcagcgagggggcctggaagcacgtgcagcggatcgagacctggatcctgcgccacccgggcttcacgatcatggccgccatcctggcgtacaccatcgggaccacccacttccagcgggccctcatcttcatcctgctgacggccgtcgcccccagcatgaccatgcgctgcatcggcatcagcaaccgggacttcgtggagggcgtgtccgggggcagctgggtcgacatcgtgctcgagcacgggtcctgcgtgaccaccatggcgaagaacaagcccacgctggacttcgagctgatcaagaccgaggccaagcagcccgccaccctccgcaagtactgcatcgaggccaagctgaccaacacgaccaccgagagccggtgcccgacccagggcgagccctccctgaacgaggagcaggacaagcgcttcatctgcaagcacagcatggtcgaccggggctgggggaacggctgcgggctgttcggcaagggcgggatcgtgacgtgcgccatgttcacgtgcaagaagaacatggagggcaaggtggtccagcccgagaacctggagtacaccatcgtgatcacgccccactccggggaggagcacgcggtgggcaacgacacggggaagcacggcaaggagatcaagatcaccccgcagagctccatcaccgaggccgagctgaccgggtacggcaccgtcacgatggagtgcagcccccgcaccggcctcgacttcaacgagatggtgctgctgcagatggaggacaaggcctggctcgtgcaccggcagtggttcctggacctgcccctcccctggctgccgggggccgacacccagggctccaactggatccagaaggagaccctggtcacgttcaagaacccccacgccaagaagcaggacgtggtcgtgctcgggagccaggagggcgcgatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgccgagacccagcacgggaccatcgtcatccgcgtgcagtacgagggcgacggcagcccctgcaagatccccttcgagatcacggacctggagaagcggcacgtgctcgggcgcctgatcaccgtcaacccgatcgtgaccgagaaggactcccccgtgaacatcgaggccgagccgcccttcggcgacagctacatcatcatcggggtcgagccgggccagctgaagctcaactggttcaagaaggggtccagcatcggccagatgttcgagaccacgatgcgcggcgcgaagcggatggccatcctgggggacaccgcctgggacttcggctccctcgggggcgtgttcaccagcatcgggaaggccctccaccaggtgttcggcgccatctacggcgcggccttctccggggtcagctggaccatgaagatcctgatcggcgtgatcatcacgtggatcgggatgaactcccgcagcacctccctgagcgtgtccctggtcctcgtgggcgtggtcaccctgtacctgggggccatggtgcaggccgacagcggctgcgtggtctcctggaagaacaaggagctcaagtgcggcagcgggatcttcatcaccgacaacgtgcacacgtggaccgagcagtacaagttccagcccgagagcccctccaagctggcgagcgccatccagaaggcccacgaggagggcatctgcgggatccggtccgtgacccgcctggagaacctcatgtggaagcagatcacccccgagctgaaccacatcctgagcgagaacgaggtcaagctcacgatcatgaccggcgacatcaaggggatcatgcaggccggcaagcggtccctgcgcccgcagcccaccgagctgaagtacagctggaagacctggggcaaggccaagatgctctccacggagagccacaaccagaccttcctgatcgacgggcccgagaccgcggagtgcccgaacaccaaccgggcctggaactccctggaggtggaggactacggcttcggggtgttcacgaccaacatctggctcaagctgcgcgagaagcaggacgtcttctgcgacagcaagctgatgtccgccgccatcaaggacaaccgggccgtgcacgcggacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacccagacggccgggccctggcacctcggcaagctggagatggacttcgacctgtgcgaggggaccaccgtggtcgtgaccgaggactgcggcaaccggggccccagcctccgcacgaccaccgcgtccgggaagctgatcaccgagtggtgctgccggagctgcacgctgcccccgctccgctaccggggcgaggacgggtgctggtacggcatggagatccgccccctgaaggagaaggaggagaacctggtgaactccctcgtcaccgccgggcacggccagatcgacaacttcagcctgggcgtgctggggatggccctcttcctggaggagatgctgcggacccgcatcggcaccaagcacgccatcctcctggtggcggcctccttcgtcacgctgatcaccgggaacatgagcttccgggacctcggccgcgtgatggtgatggtcggggccaccatgaccgacgacatcggcatgggcgtgacgtacctggccctgctcgccgcgttcaaggtgcgccccaccttcgccgccgggctgctgctccggaagctgacctccaaggagctgatgatggccaccatcggcatcgccctcctgagccagtccacgatccccgagaccatcctggagctcaccgacgcgctggccctggggatgatggtcctcaagatcgtgcgcaacatggagaagtaccagctggccgtgaccatcatggccatcagctgcgtcccgaacgccgtgatcctgcagaacgcgtggaaggtgtcctgcacgatcctcgccgccgtcagcgtgagccccctgctgctcaccagctcccagcagaaggccgactggatccccctggcgctgaccatcaagggcctcaaccccaccgccatcttcctgacgaccctgagccggacctccaagaagcgcagctggccgctcaacgaggccgtcatggccgtgggcatggtgtccatcctggccagcagcctgctcaagaacgacatccccatgaccgggcccctggtcgcgggcgggctgctcacggtgtgctacgtgctgaccggccggtccgccgacctggagctcgagcgcgccgccgacgtcaagtgggaggaccaggccgagatcagcgggtccagccccatcctgtccatcaccatcagcgaggacggctccatgagcatcaagaacgaggaggaggagcagaccctgacgatcctcatccggaccggcctgctggtgatctccggggtgttcccggtcagcatccccatcaccgcggccgcctggtacctctgggaggtgaagaagcagcgcgccggcgtgctgtgggacgtccccagcccgccgcccgtggagaaggccgagctggaggacggggcgtaccggatcaagcagcgcggcatcctcgggtacagccagatcggcgccggcgtgtacaaggaggggaccttccacaccatgtggcacgtcacgcggggcgccgtgctgatgcaccgcgggaagcggatcgagccctcctgggccgacgtgaagaaggacctgatcagctacggcgggggctggaagctcgagggcgagtggaaggagggggaggaggtccaggtgctggccctggagcccggcaagaacccccgcgcggtgcagaccaagcccgggatcttcaagaccaacaccggcacgatcggggccgtctccctcgacttcagccccggcacctccggcagccccatcgtggaccggaaggggaaggtggtcggcctgtacgggaacggcgtggtgacccgctccggcgcctacgtcagcgccatcgcgcagaccgagaagtccatcgaggacaaccccgagatcgaggacgacatcttccggaagaagcgcctgacgatcatggacctccaccccggggccggcaagaccaagcggtacctgcccgccatcgtgcgcgaggccatcaagcgggggctgcgcaccctgatcctcgccccgacccgcgtggtcgcggccgagatggaggaggccctgcggggcctgcccatccgctaccagacgcccgccatcaagaccgagcacaccgggcgggagatcgtggacctcatgtgccacgccaccttcacgatgcgcctgctgtcccccgtgcgggtcccgaactacaacctcatcatcatggacgaggcgcacttcaccgaccccgccagcatcgccgcccgcggctacatctccacccgggtggagatgggcgaggccgcggggatcttcatgaccgccacgccgcccggcagccgcgacccgttcccccagtccaacgcccccatcatggacgaggagcgggagatccccgagcgcagctggaactccgggcacgagtgggtgaccgacttcaagggcaagaccgtctggttcgtgccgagcatcaaggccgggaacgacatcgcggcctgcctgcggaagaacggcaagaaggtgatccagctgtcccgcaagaccttcgacagcgagtacgtcaagacgcgggccaacgactgggacttcgtggtgaccaccgacatctccgagatgggcgccaacttcaaggccgagcgcgtcatcgacccccggcgctgcatgaagcccgtgatcctcaccgacggggaggagcgggtgatcctggcgggccccatgccggtcacgcacagctccgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgcgatcgacggcgagtaccgcctgcgcggggaggcccgcaagaccttcgtggacctcatgcggcgcggcgacctgcccgtctggctggcctacaaggtggccgccgaggggatcaactacgcggaccggaagtggtgcttcgacggcatcaagaacaaccagatcctcgaggagaacatggaggtggagatctggaccaaggagggggagcgcaagaagctgaagccgcggtggctggacgcccgcatctactccgaccccctcgccctgaaggagttcaaggagttcgccgcgggccgcaagagcctgacgctcaacctgatcaccgagatgggccgcctgcccaccttcatgacccagaaggcccggaacgccctcgacaacctggccgtcctgcacacggccgaggccgggggccgcgcctacaaccacgccctctccgagctgcccgagaccctggagaccctcctgctgctcaccctgctggccacggtgaccgggggcatcttcctcttcctgatgagcggcaaggggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacgtacgtggtgatcgccatcctgaccgtcgtggccgcgaccatggccaacgagatgggcttcctggagaagaccaagaaggacctcgggctgggcagcatcacgacccaggagtccgagagcaacatcctggacatcgacctccgcccggcctccgcctggaccctgtacgccgtggcgaccacgttcgtcacccccatgctgcggcacagcatcgagaactccagcgtgaacgtgtccctcaccgccatcgccaaccaggccaccgtcctgatgggcctggggaagggctggcccctcagcaagatggacatcggggtgcccctgctggcgatcggctgctactcccaggtgaacccgatcacgctcaccgccgccctgctgctcctggtcgcccactacgccatcatcgggcccggcctgcaggcgaaggccacccgcgaggcccagaagcgggccgccgcgggcatcatgaagaaccccaccgtggacgggatcacggtgatcgacctcgagcccatcccgtacgaccccaagttcgagaagcagctgggccaggtcatgctgctcatcctgtgcgtgacccaggtgctgatgatgcgcaccacctgggccctctgcgaggccctgacgctggccaccgggcccatcagcaccctctgggagggcaaccccgggcggttctggaacaccacgatcgccgtctccatggcgaacatcttccgcggcagctacctggccggcgccgggctcctgttctccatcatgaagaacaccaccaacacccgccggggcacggggaacatcggcgagaccctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtgtcccgggggagcgccaagctgcgctggttcgtcgagcggaacatggtgacgccggagggcaaggtggtcgacctcggctgcgggcgcggcgggtggtcctactactgcggcgggctgaaggacgtgcgggaggtgaagggcctgaccaagggcgggcccggccacgaggagcccatccccatgagcacctacgggtggaacctcgtccgcctgcagagcggcatcgacgtgttcttcaccccgcccgagaagtgcgacacgctgctctgcgacatcggggagtccagccccaaccccaccatcgaggccggccggaccctgcgcgtgctgaacctcgtcgagaactggctgaacaacaacacccagttctgcatcaaggtgctgaacccgtacatgccctccgtgatcgagaagatggagaccctccagcggaagtacggcggggccctggtccgcaaccccctgagccggaactccacgcacgagatgtactgggtgagcaacgcgaccggcaacatcgtgtccagcgtcaacatgatctcccgcatgctgatcaaccggttcaccatgaagcacaagaaggccacctacgagccggacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtggtcccgatggtgacccagatggccatgaccgacacgacccccttcgggcagcagcgcgtgttcaaggagaaggtcgacacccggacccaggagcccaaggagggcacgaagaagctgatgaagatcaccgcggagtggctgtggaaggagctcggcaagaagaagacgccccggatgtgcacccgggaggagttcacgcgcaaggtgcggtccaacgccgccctgggggccatcttcaccgacgagaacaagtggaagtccgcccgcgaggcggtggaggacggccggttctgggagctggtcgaccgcgagcggaacctccacctggaggggaagtgcgagacctgcgtgtacaacatgatgggcaagcgcgagaagaagctgggggagttcggcaaggccaagggctcccgggccatctggtacatgtggctcggggcccgcttcctggagttcgaggcgctgggcttcctcaacgaggaccactggttcagccgggggaacagcctgtccggcgtggagggggagggcctgcaccgcctcggctacatcctgcgggacgtcgggaagaaggagggcggggccatgtacgccgacgacaccgccggctgggacacgcgcatcaccctggaggacctcaagaacgaggagatggtgaccaaccacatgaagggggagcacaagaagctggccgaggcgatcttcaagctgacctaccagaacaaggtcgtgcgggtgcagcgcccgacgccccggggcaccgtcatggacatcatcagccgccgggaccagcgcggctccggccaggtgggcacctacgggctcaacaccttcacgaacatggaggcccagctgatccgccagatggagggcgagggcatcttcaagagcatccagcacctgaccgccaccgaggagatcgccgtgcagaactggctcgcccgggtcgggcgcgagcggctgtcccgcatggcgatcagcggcgacgactgcgtggtgaagcccatcgacgaccggttcgcctccgccctgaccgccctcaacgacatggggaaggtccgcaaggacatccagcagtgggagcccagccggggctggaacgactggacccaggtgccgttctgctcccaccacttccacgagctggtgatgaaggacgggcgcgtcctggtggtgccctgccggaaccaggacgagctcatcggccgcgcccggatcagccagggcgcggggtggtccctgaaggagaccgcctgcctgggcaagagctacgcccagatgtggaccctcatgtacttccaccgccgggacctgcgcctggccgccaacgcgatctgctccgccgtccccagccactgggtgcccacctcccggaccacgtggagcatccacgccaagcacgagtggatgaccaccgaggacatgctcgccgtgtggaaccgcgtctggatccaggagaacccgtggatggaggacaagacccccgtggagtcctgggaggaggtgccctacctggggaagcgggaggaccagtggtgcggcagcctgatcgggctcacgagccgcgcgacctgggccaagaacatccagaccgccatcaaccaggtccggtccctgatcggcaacgaggagtacaccgactacatgcccagcatgaagcgcttccgcaaggaggaggaggaggccggcgtgctgtggtga

SEQ ID NO: 9199 - RNA, 9876 nt, synthetic construct
  misc_feature 1..9876: note = derived and/or modified CDS sequence (opt1) from DENV-2__KJ189311__SS-prME
  source 1..9876: mol_type = other RNA
accgcgggcgtgatcgtcatgctgatccccaccgtgatggccttccacctcaccacccggaacggggagccgcacatgatcgtgggccggcaggagaagggcaagagcctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaactccaccagcacctggatcacctacgggacctgctccaccaccggcgagcaccggcgcgagaagcggagcgtggccctggtgccccacgtcgggatgggcctcgagacccgcaccgagacctggatgtccagcgagggggcctggaagcacgtgcagcggatcgagacctggatcctgcgccacccgggcttcaccatcatggccgccatcctggcgtacaccatcgggaccacccacttccagcgggccctcatcttcatcctgctgacggccgtggccccctccatgaccatgcgctgcatcggcatcagcaaccgggacttcgtcgagggcgtgtccgggggcagctgggtggacatcgtcctcgagcacgggtcctgcgtgaccaccatggcgaagaacaagcccacgctggacttcgagctgatcaagaccgaggccaagcagcccgccaccctccgcaagtactgcatcgaggccaagctgaccaacacgaccaccgagagccggtgcccgacccagggcgagccctccctgaacgaggagcaggacaagcgcttcatctgcaagcacagcatggtggaccggggctgggggaacggctgcgggctgttcggcaagggcgggatcgtcacgtgcgccatgttcacgtgcaagaagaacatggagggcaaggtggtgcagcccgagaacctggagtacaccatcgtcatcacgccccactccggggaggagcacgcggtgggcaacgacacggggaagcacggcaaggagatcaagatcaccccgcagagctccatcaccgaggccgagctgaccgggtacggcaccgtgacgatggagtgcagcccccgcaccggcctcgacttcaacgagatggtcctgctgcagatggaggacaaggcctggctcgtgcaccggcagtggttcctggacctgcccctcccctggctgccgggggccgacacccagggctccaactggatccagaaggagaccctggtgacgttcaagaacccccacgccaagaagcaggacgtcgtggtcctcgggagccaggagggcgcgatgcacaccgccctgaccggggccaccgagatccagatgagctccggcaacctcctgttcacgggccacctgaagtgccgcctgcggatggacaagctccagctgaaggggatgagctactccatgtgcaccggcaagttcaagatcgtgaaggagatcgccgagacccagcacgggaccatcgtgatccgcgtccagtacgagggcgacggcagcccctgcaagatccccttcgagatcacggacctggagaagcggcacgtgctcgggcgcctgatcaccgtgaacccgatcgtcaccgagaaggactcccccgtgaacatcgaggccgagccgcccttcggcgacagctacatcatcatcggggtggagccgggccagctgaagctcaactggttcaagaaggggtccagcatcggccagatgttcgagaccacgatgcgcggcgcgaagcggatggccatcctgggggacaccgcctgggacttcggctccctcggcggggtcttcaccagcatcgggaaggccctccaccaggtgttcggggccatctacggcgcggccttctccggggtgagctggaccatgaagatcctgatcggcgtcatcatcacgtggatcgggatgaactcccgcagcacctccctgagcgtgtccctggtgctcgtcggcgtggtgatcctgtacctgggggccatggtccaggccgacagcggctgcgtggtgtcctggaagaacaaggagctcaagtgcggcagcgggatcttcatcaccgacaacgtccacacctggacggagcagtacaagttccagcccgagagcccctccaagctggcgagcgccatccagaaggcccacgaggagggcatctgcgggatccggtccgtgacccgcctggagaacctcatgtggaagcagatcacccccgagctgaaccacatcctgagcgagaacgaggtgaagctcaccatcatgacgggcgacatcaaggggatcatgcaggccggcaagcggtccctgcgcccgcagcccaccgagctgaagtacagctggaagacctggggcaaggccaagatgctctccaccgagagccacaaccagacgttcctgatcgacgggcccgagaccgcggagtgcccgaacaccaaccgggcctggaactccctggaggtcgaggactacggcttcggggtgttcaccacgaacatctggctcaagctgcgcgagaagcaggacgtgttctgcgacagcaagctgatgtccgccgccatcaaggacaaccgggccgtccacgcggacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacccagaccgccgggccctggcacctcggcaagctggagatggacttcgacctgtgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcatcggcaccaagcacgccatcctcctggtggcggcctccttcgtgaccctgatcacggggaacatgagcttccgggacctcggccgcgtcatggtgatggtgggggccaccatgaccgacgacatcggcatgggcgtcacctacctggccctgctcgccgcgttcaaggtgcgccccacgttcgccgccgggctgctgctccggaagctgacctccaaggagctgatgatggccaccatcggcatcgccctcctgagccagtccaccatccccgagagcatcctggagctcacggacgcgctggccctggggatgatggtgctcaagatcgtccgcaacatggagaagtaccagctggccgtgaccatcatggccatctcctgcgtgccgaacgccgtcatcctgcagaacgcgtggaaggtgagctgcaccatcctcgccgccgtgtccgtcagccccctgctgctcacctccagccagcagaaggccgactggatccccctggcgctgacgatcaagggcctcaaccccaccgccatcttcctgaccaccctgtcccggacgagcaagaagcgctcctggccgctcaacgaggccgtgatggccgtcggcatggtgagcatcctggccagctccctgctcaagaacgacatccccatgaccgggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcacgatctccgaggacggcagcatgtccatcaagaacgaggaggaggagcagaccctgaccatcctcatccggaccggcctgctggtcatcagcggggtgttcccggtgtccatccccatcacggcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacaccatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagacgaacaccggcaccatcggggccgtgagcctcgacttctcccccggcaccagcggctcccccatcgtcgaccggaaggggaaggtggtgggcctgtacgggaacggcgtcgtgacgcgcagcggcgcctacgtgagcgccatcgcgcagaccgagaagtccatcgaggacaacctggagatcgaggacgacatcttccggaagaagcgcctcaccatcatggacctgcaccccggggccggcaagaccaagcggtacctgcccgccatcgtccgcgaggccatcaagcgggggctgcgcacgctcatcctggcccccacccgcgtggtggcggccgagatggaggaggccctgcggggcctcccgatccgctaccagacccccgccatcaagaccgagcacacggggcgggagatcgtcgacctgatgtgccacgccaccttcaccatgcgcctgctcagccccgtgcgggtgcccaactacaacctgatcatcatggacgaggcgcacttcaccgacccggcctccatcgccgcccgcggctacatcagcacgcgggtcgagatgggcgaggccgcggggatcttcatgaccgccacgccgcccggctcccgcgaccccttcccgcagagcaacgcccccatcatggacgaggagcgggagatccccgagcgctcctggaacagcgggcacgagtgggtgaccgacttcaagggcaagacggtgtggttcgtcccctccatcaaggccgggaacgacatcgcggcctgcctgcggaagaacggcaagaaggtgatccagctcagccgcaagaccttcgactccgagtacgtgaagacccgggccaacgactgggacttcgtcgtgaccacggacatcagcgagatgggcgccaacttcaaggccgagcgcgtgatcgacccgcggcgctgcatgaagcccgtcatcctgaccgacggggaggagcgggtgatcctggcgggccccatgcccgtgacccactccagcgccgcccagcgccgggggcgcatcggccgcaacccgaagaacgagaacgaccagtacatctacatgggggagcccctcgagaacgacgaggactgcgcccactggaaggaggccaagatgctgctggacaacatcaacacccccgagggcatcatcccctccatgttcgagccggagcgggagaaggtcgacgcgatcgacggcgagtaccgcctccgcggggaggcccgcaagacgttcgtggacctgatgcggcgcggcgacctgcccgtgtggctcgcctacaaggtcgccgccgaggggatcaactacgcggaccggaagtggtgcttcgacggcatcaagaacaaccagatcctggaggagaacatggaggtggagatctggaccaaggagggggagcgcaagaagctgaagccccggtggctcgacgcccgcatctacagcgacccgctggccctgaaggagttcaaggagttcgccgcgggccggaagtccctcaccctgaacctgatcaccgagatgggccgcctccccacgttcatgacccagaaggcccggaacgccctggacaacctggccgtgctccacaccgccgaggccgggggccgcgcctacaaccacgccctgagcgagctgcccgagaccctcgagacgctgctgctcctgaccctgctcgccaccgtcaccgggggcatcttcctgttcctgatgtccggcaaggggatcggcaagatgacgctcgggatgtgctgcatcatcaccgccagcatcctgctgtggtacgcgcagatccagccccactggatcgccgccagcatcatcctcgagttcttcctgatcgtgctgctcatcccggagcccgagaagcagcggacgccccaggacaaccagctgacctacgtcgtgatcgccatcctgaccgtggtcgccgcgacgatggccaacgagatgggcttcctcgagaagaccaagaaggacctggggctgggctccatcaccacccaggagagcgagtccaacatcctcgacatcgacctgcgccccgccagcgcctggacgctgtacgccgtggcgaccaccttcgtgaccccgatgctccggcactccatcgagaacagctccgtcaacgtgagcctgacggccatcgccaaccaggccaccgtgctgatgggcctcgggaagggctggcccctgtccaagatggacatcggggtccccctgctcgcgatcggctgctacagccaggtgaaccccatcaccctgaccgccgccctgctcctgctggtggcccactacgccatcatcgggccgggcctccaggcgaaggccacgcgcgaggcccagaagcgggccgccgcgggcatcatgaagaaccccaccgtcgacgggatcaccgtgatcgacctggagcccatcccctacgacccgaagttcgagaagcagctgggccaggtgatgctcctgatcctgtgcgtcacccaggtgctcatgatgcgcacgacctgggccctgtgcgaggccctgaccctcgccaccgggcccatctccacgctgtgggagggcaaccccgggcggttctggaacaccaccatcgccgtgagcatggcgaacatcttccgcggctcctacctggccggcgccgggctcctgttcagcatcatgaagaacaccacgaacacccgccggggcaccgggaacatcggcgagaccctgggcgagaagtggaagtcccgcctcaacgccctgggcaagagcgagttccagatctacaagaagtccggcatccaggaggtcgaccggacgctggcgaaggaggggatcaagcgcggcgagaccgaccaccacgccgtgagccgggggtccgccaagctccgctggttcgtggagcggaacatggtcacccccgagggcaaggtggtggacctgggctgcgggcgcggcgggtggagctactactgcggcgggctgaaggacgtccgggaggtgaagggcctcaccaagggcgggccgggccacgaggagcccatccccatgagcacgtacgggtggaacctggtgcgcctgcagtccggcatcgacgtcttcttcacgccgcccgagaagtgcgacaccctcctgtgcgacatcggggagagctcccccaaccccaccatcgaggccggccggacgctgcgcgtgctcaacctggtggagaactggctgaacaacaacacccagttctgcatcaaggtcctcaacccctacatgcccagcgtgatcgagaagatggagaccctgcagcggaagtacggcggggccctggtgcgcaaccccctgtcccggaacagcacccacgagatgtactgggtctccaacgcgaccggcaacatcgtgagctccgtgaacatgatcagccgcatgctcatcaaccggttcacgatgaagcacaagaaggccacctacgagcccgacgtcgacctggggtccggcacccgcaacatcgggatcgagagcgagatcccgaacctggacatcatcggcaagcggatcgagaagatcaagcaggagcacgagacctcctggcactacgaccaggaccacccctacaagacgtgggcctaccacggcagctacgagaccaagcagaccgggtccgccagctccatggtgaacggcgtggtccgcctcctgaccaagccctgggacgtggtgcccatggtcacgcagatggccatgaccgacaccaccccgttcgggcagcagcgcgtgttcaaggagaaggtggacacgcggacccaggagcccaaggagggcaccaagaagctgatgaagatcaccgcggagtggctctggaaggagctgggcaagaagaagacgccccgcatgtgcacccgggaggagttcacccgcaaggtccggagcaacgccgccctgggggccatcttcaccgacgagaacaagtggaagtccgcccgcgaggcggtggaggacggccggttctgggagctcgtggaccgcgagcggagcctgcacctggaggggaagtgcgagacgtgcgtctacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggggaacagcctgtccggcgtggagggggagggcctccaccgcctgggctacatcctgcgggacgtggggaagaaggagggcggggccatgtacgccgacgacaccgccggctgggacacccgcatcaccctcgaggacctgaagaacgaggagatggtcacgaaccacatgaagggggagcacaagaagctggccgaggcgatcttcaagctcacctaccagaacaaggtggtccgggtgcagcgccccaccccgcggggcaccgtgatggacatcatcagccgccgggaccagcgcggctccgggcaggtcggcacgtacgggctgaacaccttcaccaacatggaggcccagctgatccgccagatggagggcgagggcatcttcaagaacatccagcacctcaccgccacggaggagatcgccgtgcagaactggctggcccgggtggggcgcgagcggctgagccgcatggcgatctccggcgacgactgcgtcgtgaagcccatcgacgaccggttcgccagcgccctcaccgccctgaacgacatggggaaggtgcgcaaggacatccagcagtgggagccctcccggggctggaacgactggacccaggtccccttctgcagccaccacttccacgagctggtgatgaaggacgggcgcgtgctcgtcgtgccgtgccggaaccaggacgagctgatcggccgcgcccggatctcccagggcgcggggtggagcctgaaggagaccgcctgcctcggcaagtcctacgcccagatgtggacgctgatgtacttccaccgccgggacctgcgcctcgccgccaacgcgatctgcagcgccgtgccctcccactgggtccccaccagccggaccacctggtccatccacgccaagcacgagtggatgaccacggaggacatgctggccgtgtggaaccgcgtgtggatccaggagaacccctggatggaggacaagaccccggtcgagagctgggaggaggtgccctacctggggaagcgggaggaccagtggtgcggcagcctcatcgggctgacctcccgcgcgacctgggccaagaacatccagacggccatcaaccaggtgcggagcctgatcggcaacgaggagtacaccgactacatgccctccatgaagcgcttccgcaaggaggaggaggaggccggcgtcctctggtga

SEQ ID NO: 9200 - RNA, 9876 nt, synthetic construct
  misc_feature 1..9876: note = derived and/or modified CDS sequence (opt1) from DENV-2__KJ189370__SS-prME
  source 1..9876: mol_type = other RNA
accgcgggcgtgatcgtcatgctgatccccaccgccatggcgttccacctcaccacccggaacggggagccccacatgatcgtgtcccggcaggagaagggcaagtccctgctgttcaagaccgaggacggggtgaacatgtgcaccctcatggccatcgacctgggcgagctgtgcgaggacaccatcacctacaagtgccccctcctgcgccagaacgagcccgaggacatcgactgctggtgcaacagcacctccacctgggtcacctacgggacctgcaccaccaccggcgagcaccggcgggagaagcggagcgtggccctggtgccccacgtcggcatggggctcgagacccgcaccgagacctggatgtccagcgagggcgcctggaagcacgtgcagcggatcgagacgtggatcctgcgccacccggggttcaccatcatggccgcgatcctggcctacaccatcggcaccacgcacttccagcgggccctcatcttcatcctgctgaccgccgtggcgccctccatgaccatgcgctgcatcgggatcagcaaccgggacttcgtcgagggcgtgtccggcgggagctgggtggacatcgtcctcgagcacggctcctgcgtgaccacgatggccaagaacaagcccaccctggacttcgagctgatcaagaccgaggccaagcagcccgccaccctccgcaagtactgcatcgaggccaagctgacgaacaccaccaccgagagccggtgcccgacgcagggggagccctccctgaacgaggagcaggacaagcgcttcatctgcaagcacagcatggtggaccggggctggggcaacgggtgcggcctcttcgggaagggcgggatcgtgacctgcgcgatgttcacgtgcaagaagaacatggagggcaaggtggtgcagcccgagaacctggagtacaccatcgtcatcacgccccactccggcgaggagcacgccgtggggaacgacaccggcaagcacgggaaggagatcaagatcaccccgcagagctccatcaccgaggccgagctgaccggctacgggacggtgaccatggagtgcagcccccgcaccggcctcgacttcaacgagatggtcctgctgcagatggaggacaaggcctggctcgtgcaccggcagtggttcctggacctgcccctcccctggctgccgggcgccgacacccaggggtccaactggatccagaaggagacgctggtgaccttcaagaacccccacgcgaagaagcaggacgtcgtggtcctcggcagccaggagggggccatgcacaccgccctgaccggcgccacggagatccagatgagctccgggaacctcctgttcaccggccacctgaagtgccgcctgcggatggacaagctccagctgaagggcatgagctactccatgtgcaccgggaagttcaagatcgtgaaggagatcgccgagacccagcacggcacgatcgtgatccgcgtccagtacgagggggacggcagcccctgcaagatccccttcgagatcaccgacctggagaagcggcacgtgctcggccgcctgatcaccgtgaacccgatcgtcaccgagaaggactcccccgtgaacatcgaggcggagccgcccttcggggacagctacatcatcatcggcgtggagccggggcagctgaagctcaactggttcaagaagggctccagcatcgggcagatgttcgagacgaccatgcgcggcgccaagcggatggccatcctgggcgacaccgcctgggacttcgggtccctgggcggggtcttcaccagcatcggcaaggccctccaccaggtgttcggggcgatctacggcgccgccttctccggcgtgagctggacgatgaagatcctgatcggggtcatcatcacctggatcggcatgaactcccgcagcacctccctgagcgtgtccctggtgctcgtcggggtggtgaccctgtacctgggcgccatggtccaggcggacagcgggtgcgtggtgtcctggaagaacaaggagctcaagtgcggcagcggcatcttcatcacggacaacgtccacacctggaccgagcagtacaagttccagcccgagagcccctccaagctggccagcgccatccagaaggcccacgaggaggggatctgcggcatccggtccgtgacccgcctggagaacctcatgtggaagcagatcacgcccgagctgaaccacatcctgagcgagaacgaggtgaagctcaccatcatgaccggggacatcaagggcatcatgcaggccgggaagcggtccctgcgcccgcagcccaccgagctgaagtacagctggaagacgtggggcaaggcgaagatgctctccaccgagagccacaaccagaccttcctgatcgacggccccgagaccgccgagtgcccgaacacgaaccgggcctggaactccctggaggtcgaggactacgggttcggcgtgttcaccaccaacatctggctcaagctgaaggagaagcaggacgtgttctgcgacagcaagctgatgtccgccgccatcaaggacaaccgcgcggtccacgccgacatggggtactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccggccccgtgagccagcacaactaccggccggggtaccacacgcagaccgcgggcccctggcacctcgggaagctggagatggacttcgacctgtgcgagggcaccaccgtggtggtcacggaggactgcgggaaccgcggccccagcctccggaccaccaccgcctccggcaagctgatcacggagtggtgctgccgcagctgcaccctgcccccgctccggtaccgcggggaggacggctgctggtacgggatggagatccggcccctgaaggagaaggaggagaacctggtgaactccctcgtgaccgccggccacgggcagatcgacaacttcagcctgggcgtcctgggcatggccctcttcctggaggagatgctgcgcacccggatcgggacgaagcacgcgatcctcctggtggccgtgtccttcgtcaccctgatcaccggcaacatgagcttccgcgacctcgggcgggtgatggtgatggtcggcgccaccatgacggacgacatcgggatgggcgtgacctacctggccctgctcgccgcgttcaaggtgcgccccaccttcgccgccggcctgctgctccgcaagctgacctccaaggagctgatgatggccacgatcgggatcgccctcctgagccagtccaccatccccgagaccatcctggagctcaccgacgcgctggccctgggcatgatggtcctcaaggtggtgcggaacatggagaagtaccagctggccgtcacgatcatggccatcagctgcgtgccgaacgccgtgatcctgcagaacgcgtggaaggtctcctgcaccatcctcgccgccgtgagcgtcagccccctgctgctcaccagctcccagcagaaggccgactggatccccctggcgctgaccatcaaggggctcaaccccacggccatcttcctgaccaccctgagccgcacctccaagaagcggagctggccgctcaacgaggccatcatggccgtgggcatggtgtccatcctggccagcagcctgctcaagaacgacatccccatgacgggccccctggtcgccggcgggctgctcaccgtgtgctacgtgctgaccgggcgctccgccgacctggagctcgagcgggccgccgacgtcaagtgggaggaccaggccgagatcagcgggtccagccccatcctgtccatcaccatcagcgaggacgggtccatgagcatcaagaacgaggaggaggagcagacgctgaccatcctcatccgcaccggcctgctggtgatctccggcgtgttcccggtcagcatccccatcaccgcggccgcctggtacctctgggaggtgaagaagcagcgggccggggtgctgtgggacgtccccagcccgccgcccgtggagaaggccgagctggaggacggcgcgtaccgcatcaagcagcgggggatcctcggctacagccagatcggggccggcgtgtacaaggagggcaccttccacacgatgtggcacgtcacccgcggggccgtgctgatgcaccggggcaagcgcatcgagccctcctgggccgacgtgaagaaggacctgatcagctacgggggcgggtggaagctcgagggcgagtggaaggagggcgaggaggtccaggtgctggccctggagcccgggaagaacccccgggcggtgcagaccaagcccggcatcttcaagaccaacacggggaccatcggcgccgtctccctcgacttcagccccgggacctccggcagccccatcgtggaccgcaagggcaaggtggtcgggctgtacggcaacggggtggtgacccggtccggcgcctacgtcagcgccatcgcgcagacggagaagtccatcgaggacaaccccgagatcgaggacgacatcttccgcaagaagcggctgaccatcatggacctccaccccggcgccgggaagaccaagcgctacctgcccgccatcgtgcgggaggccatcaagcgcggcctgcggaccctgatcctcgccccgacgcgcgtggtcgcggccgagatggaggaggccctgcgcgggctgcccatccggtaccagacccccgccatcaaggccgagtacaccggccgcgagatcgtggacctcatgtgccacgcgaccttcacgatgcggctgctgtcccccgtgcgcgtcccgaactacaacctcatcatcatggacgaggcccacttcaccgaccccgccagcatcgccgcccgggggtacatctccacccgcgtggagatgggcgaggcggccggcatcttcatgaccgccacgccgcccgggagccgggacccgttcccccagtccaacgcccccatcatggacgaggagcgcgagatccccgagcggagctggaactccggccacgagtgggtgaccgacttcaaggggaagaccgtctggttcgtgccgagcatcaaggcgggcaacgacatcgccgcctgcctgcgcaagaacgggaagaaggtgatccagctgtcccggaagaccttcgacagcgagtacgtcaagacgcgcgccaacgactgggacttcgtggtgaccaccgacatctccgagatgggcgccaacttcaaggcggagcgggtcatcgacccccgccggtgcatgaagcccgtgatcctcaccgacggcgaggagcgcgtgatcctggccgggcccatgccggtcacgcacagctccgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacccccgaggggatcatcccgagcatgttcgagcccgagcgcgagaaggtggacgccatcgacggcgagtaccggctgcgcggcgaggcccggaagaccttcgtggacctcatgcgccgcggggacctgcccgtctggctggcctacaaggtggccgcggagggcatcaactacgccgaccgcaagtggtgcttcgacgggatcaagaacaaccagatcctcgaggagaacatggaggtggagatctggaccaaggagggcgagcggaagaagctgaagccgcgctggctggacgcccggatctactccgaccccctcgccctgaaggagttcaaggagttcgcggccgggcgcaagagcctgacgctcaacctgatcaccgagatgggccggctgcccaccttcatgacccagaaggcccgcaacgccctcgacaacctggccgtcctgcacacggcggaggccggcgggcgggcctacaaccacgccctctccgagctgcccgagaccctggagaccctcctgctgctcaccctgctggccacggtgaccggcgggatcttcctcttcctgatgagcggcaagggcatcgggaagatgaccctgggcatgtgctgcatcatcaccgcgtccatcctcctgtggtacgcccagatccagccgcactggatcgccgccagcatcatcctggagttcttcctcatcgtcctgctgatccccgagcccgagaagcagcgcacgccccaggacaaccagctcacgtacgtggtgatcgccatcctgaccgtcgtggcggccaccatggccaacgagatggggttcctggagaagaccaagaaggacctcggcctggggagcatcacgacccaggagtccgagagcaacatcctggacatcgacctccggccggcctccgcctggaccctgtacgcggtggccaccacgttcctgacccccatgctccgccacagcatcgagaactccagcgtcaacgtgtccctgaccgccatcgccaaccaggcgaccgtgctgatgggcctcggcaaggggtggcccctgagcaagatggacatcggcgtccccctgctcgccatcgggtgctactcccaggtgaacccgatcacgctgaccgccgccctgctcctgctggtggcccactacgcgatcatcggccccgggctccaggccaaggccacccgggaggcccagaagcgcgccgcggccggcatcatgaagaaccccaccgtcgacggcatcacggtgatcgacctggaccccatcccgtacgaccccaagttcgagaagcagctggggcaggtcatgctcctgatcctgtgcgtcacccaggtgctcatgatgcggaccacctgggccctgtgcgaggccctgacgctcgccaccggccccatcagcaccctgtgggaggggaaccccggccgcttctggaacaccacgatcgcggtgtccatggccaacatcttccgggggagctacctggccggcgccggcctcctgttctccatcatgaagaacaccaccagcacccgccgcgggacgggcaacatcggggagaccctgggcgagaagtggaagtcccggctcaacgcgctgggcaagagcgagttccagatctacaagaagtccgggatccaggaggtcgaccgcaccctggccaaggagggcatcaagcgcggggagaccgaccaccacgccgtgagccgcggctccgccaagctccggtggttcgtggagcgcaacatggtcacgccggaggggaaggtggtggacctgggctgcggccgcgggggctggagctactactgcgggggcctgaagaacgtccgcgaggtgaaggggctcaccaagggcggccccgggcacgaggagcccatccccatgagcacctacggctggaacctggtgcggctgcagtccggggtcgacgtgttcttcaccccgcccgagaagtgcgacacgctcctgtgcgacatcggcgagagctcccccaaccccaccatcgaggccgggcgcaccctgcgggtgctcaacctggtcgagaactggctgaacaacaacacccagttctgcatcaaggtgctcaacccgtacatgcccagcgtgatcgagaagatggaggcgctgcagcgcaagtacggcggcgccctggtccggaaccccctgtcccgcaacagcacccacgagatgtactgggtgtccaacgccacggggaacatcgtgagctccgtcaacatgatcagccggatgctcatcaaccgcttcaccatgaagcacaagaaggccacctacgagccggacgtggacctgggctccgggacccggaacatcggcatcgagagcgaggtgcccaacctggacatcatcgggaagcgcatcgagaagatcaagcaggagcacgagacgtcctggcactacgaccaggaccacccctacaagacctgggcctaccacggcagctacgagaccaagcagaccggctccgcgagctccatggtcaacggggtggtgcggctcctgacgaagccctgggacgtcgtgccgatggtgacccagatggccatgaccgacaccacgcccttcggccagcagcgcgtcttcaaggagaaggtggacacccgcacccaggagcccaaggaggggaccaagaagctgatgaagatcacggccgagtggctctggaaggagctgggcaagaagaagacgccccggatgtgcacccgcgaggagttcacccggaaggtgcgcagcaacgccgccctgggcgcgatcttcacggacgagaacaagtggaagtccgcccgggaggccgtcgaggacgggcgcttctgggagctcgtggaccgggagcgcaacctgcacctggagggcaagtgcgagacctgcgtgtacaacatgatggggaagcgggagaagaagctcggcgagttcgggaaggccaagggcagccgcgcgatctggtacatgtggctgggcgcccggttcctggagttcgaggccctcgggttcctgaacgaggaccactggttcagccgcggcaactccctgagcggggtcgagggcgaggggctccaccggctgggctacatcctgcgcgaggtgggcaagaaggagggcggcgccatgtacgccgacgacaccgcggggtgggacacccggatcacgctcgaggacctgaagaacgaggagatggtcaccaaccacatgaagggcgagcacaagaagctggccgaggccatcttcaagctcacctaccagaacaaggtggtgcgcgtccagcggccgacgccccgggggacggtgatggacatcatctcccggcgcgaccagcggggcagcggccaggtggggacctacggcctgaacaccttcaccaacatggaggcccagctgatccgccagatggagggggagggcatcttcaagtccatccagcacctcacggccaccgaggagatcgcggtccagaactggctggtgcgcgtgggccgggagcgcctgagccggatggccatctccggggacgactgcgtcgtgaagcccatcgacgaccgcttcgccagcgccctcaccgccctgaacgacatgggcaaggtgcggaaggacatccagcagtgggagccctcccgcgggtggaacgactggacccaggtcccgttctgcagccaccacttccacgagctggtgatgaaggacggccgggtgctcgtcgtgccctgccgcaaccaggacgagctgatcgggcgggcgcgcatctcccagggcgccggctggagcctgaaggagacggcctgcctcgggaagtcctacgcccagatgtggaccctgatgtacttccaccggcgcgacctgcggctcgccgcgaacgccatctgcagcgccgtgccctcccactgggtccccaccagccgcaccacctggtccatccacgccaagcacgagtggatgacgaccgaggacatgctggcggtgtggaaccgggtgtggatccaggagaacccgtggatggaggacaagacccccgtcgagagctgggaggaggtgccctacctgggcaagcgcgaggaccagtggtgcgggagcctcatcggcctgacctcccgggccacgtgggccaagaacatccagaccgccatcaaccaggtgcgcagcctgatcgggaacgaggagtacaccgactacatgccctccatgaagcggttccgccgcgaggaggaggaggccggcgtcctctggtga

SEQ ID NO: 9201 - RNA, 9876 nt, synthetic construct
  misc_feature 1..9876: note = derived and/or modified CDS sequence (opt1) from DENV-2__EU482620__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacacggaccggaagtggtgcttcgacggcatcaagaacaaccagatcctggaggagaacatggaggtggagatctggaccaaggagggggagcgcaagaagctcaagccgcggtggctggacgcgcgcatctacagcgaccccctggccctcaaggagttcaaggagttcgccgccggccggaagtccctgaccctgaacctcatcaccgagatgggccgcctgcccacgttcatgacccagaaggcgcggaacgccctggacaacctcgccgtcctgcacaccgccgaggccgggggccgcgcgtacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggccagcatcctgctctggtacgcccagatccagccgcactggatcgcggcctccatcatcctggagttcttcctgatcgtcctcctgatccccgagcccgagaagcagcggacgccccaggacaaccagctgacctacgtggtgatcgccatcctcaccgtcgtggccgccacgatggcgaacgagatgggcttcctggagaagaccaagaaggacctggggctcggcagcatcaccacccaggagagcgagtccaacatcctggacatcgacctgcgcccggccagcgcctggacgctctacgccgtggccaccaccttcgtcacccccatgctgcggcactccatcgagaacagctccgtgaacgtgagcctgacggcgatcgccaaccaggccaccgtcctcatgggcctggggaagggctggcccctgtccaagatggacatcggggtgcccctcctggccatcggctgctacagccaggtgaacccgatcaccctgaccgcggccctcctgctgctcgtcgcccactacgccatcatcgggcccggcctgcaggccaaggcgacgcgcgaggcccagaagcgggccgccgccggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcgcacgacctgggcgctgtgcgaggccctcaccctggccaccgggcccatctccacgctgtgggagggcaaccccgggcggttctggaacaccaccatcgccgtcagcatggccaacatcttccgcggctcctacctcgcgggcgccgggctgctgttcagcatcatgaagaacaccacgtccacccgccggggcaccgggaacatcggcgagaccctcggcgagaagtggaagtcccgcctgaacgccctggggaagtccgagttccagatctacaagaagtccggcatccaggaggtggaccggacgctcgccaaggaggggatcaagcgcggcgagaccgaccaccacgcggtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacgtacgggtggaacctggtccgcctccagagcggcgtggacgtgttcttcaccccgcccgagaagtgcgacaccctgctgtgcgacatcggggagtccagccccaaccccaccatcgaggccggccggaccctccgcgtcctgaacctggtggagaactggctcaacaacaacacgcagttctgcatcaaggtgctgaacccgtacatgccctccgtcatcgagaagatggaggccctgcagcggcagtacggcggggccctcgtgcgcaaccccctgagccggaactccacccacgagatgtactgggtgagcaacgcgaccggcaacatcgtctccagcgtgaacatgatctcccgcatgctgatcaaccggttcaccatgaagcacaagaaggccacgtacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagacggggagcgcctccagcatggtcaacggcgtggtgcgcctgctgaccaagccctgggacgtcgtgccgatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagacgccccgcatgtgcacccgggaggagttcacgcgcaaggtgcggtccaacgccgccctcggggccatcttcaccgacgagaacaagtggaagtccgcccgcgaggcggtcgaggacggccggttctgggagctggtggaccgcgagcggaacctgcacctcgaggggaagtgcgagacctgcgtgtacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggggaacagcctctccggcgtcgagggggagggcctgcaccgcctgggctacatcctccgggacgtggggaagaaggagggcggggccatgtacgccgacgacaccgccggctgggacacgcgcatcaccctggaggacctgaagaacgaggagatggtcaccaaccacatgaagggggagcacaagaagctcgccgaggcgatcttcaagctgacctaccagaacaaggtggtgcgggtccagcgcccgacgccccggggcaccgtgatggacatcatcagccgccgggaccagcgcggctccgggcaggtcggcacctacgggctgaacaccttcacgaacatggaggcccagctcatccgccagatggagggcgagggcatcttcaagagcatccagcacctgaccgccaccgaggagatcgccgtccagaactggctggcccgggtggggcgcgagcggctctcccgcatggcgatcagcggcgacgactgcgtggtcaagcccatcgacgaccggttcgcctccgccctgaccgccctgaacgacatggggaaggtgcgcaaggacatccagcagtgggagcccagccggggctggaacgactggacccaggtgccgttctgctcccaccacttccacgagctcgtcatgaaggacgggcgcgtgctggtggtcccctgccggaaccaggacgagctgatcggccgcgcccggatcagccagggcgcggggtggtccctcaaggagaccgcctgcctgggcaagagctacgcccagatgtggaccctgatgtacttccaccgccgggacctccgcctggccgccaacgcgatctgctccgccgtgcccagccactgggtgcccacctcccggaccacgtggagcatccacgccaagcacgagtggatgaccaccgaggacatgctggccgtctggaaccgcgtgtggatccaggagaacccgtggatggaggacaagacccccgtggagtcctgggaggaggtcccctacctcgggaagcgggaggaccagtggtgcggcagcctgatcgggctgacgagccgcgcgacctgggccaagaacatccagaccgccatcaaccaggtgcggtccctcatcggcaacgaggagtacaccgactacatgcccagcatgaagcgcttccgccgggaggaggaggaggccggcgtgctgtggtga

SEQ ID NO: 9202 - RNA, 9876 nt, synthetic construct
  misc_feature 1..9876: note = derived and/or modified CDS sequence (opt1) from DENV-2__FJ373300__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggaccatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtggtcgtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacgcgcatcggcaccaagcacgcgatcctgctcgtggccgtcagcttcgtgaccctgatcaccgggaacatgtccttccgggacctgggccgcgtgatggtcatggtgggggccacgatgaccgacgacatcggcatgggcgtgacctacctcgccctgctggccgcgttcaaggtccgccccaccttcgccgccgggctcctgctgcggaagctcacgagcaaggagctgatgatggccaccatcggcatcgccctgctctcccagagcaccatccccgagaccatcctggagctgacggacgcgctcgccctggggatgatggtgctgaagatcgtgcgcaacatggagaagtaccagctcgccgtcaccatcatggccatctcctgcgtgccgaacgccgtgatcctgcagaacgcgtggaaggtcagctgcaccgtgctggccgccgtctccgtgagccccctcctgctgacctccagccagcagaaggccgactggatccccctcgcgctgacgatcaagggcctgaaccccaccgccatcttcctcaccaccctgtcccggacgagcaagaagcgctcctggccgctgaacgaggccatcatggccgtgggcatggtcagcatcctcgcctccagcctgctgaagaacgacatccccatgaccgggcccctcgtggcgggcgggctgctgaccgtgtgctacgtcctcaccggccggagcgccgacctggagctggagcgcgccgccgacgtgaagtgggaggaccaggccgagatctccgggagctcccccatcctcagcatcacgatctccgaggacggcagcatgtccatcaagaacgaggaggaggagcagaccctgaccatcctgatccggaccggcctcctggtgatcagcggggtcttcccggtgtccatccccatcaccgcggccgcctggtacctgtgggaggtgaagaagcagcgcgccggcgtcctctgggacgtgcccagcccgccgcccgtggagaaggccgagctggaggacggggcgtaccggatcaagcagcgcggcatcctggggtactcccagatcggcgccggcgtctacaaggaggggacgttccacaccatgtggcacgtgacccggggcgccgtgctcatgcaccgcgggaagcggatcgagcccagctgggccgacgtcaagaaggacctgatctcctacggcgggggctggaagctggagggcgagtggaaggagggggaggaggtccaggtgctcgccctggagcccggcaagaacccccgcgcggtccagaccaagcccgggatcttcaagacgaacaccggcaccatcggggccgtgagcctggacttctcccccggcaccagcggctcccccatcgtggaccggaaggggaaggtcgtgggcctctacgggaacggcgtggtcacgcgcagcggcgcctacgtgtccgccatcgcgcagaccgagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcacgctgatcctggccccgacccgcgtcgtggcggccgagatggaggaggccctccggggcctgcccatccgctaccagacccccgccatcaagaccgagcacacggggcgggagatcgtggacctgatgtgccacgccaccttcaccatgcgcctcctgagccccgtccgggtgccgaactacaacctgatcatcatggacgaggcgcacttcaccgaccccgcctccatcgccgcccgcggctacatcagcacgcgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtcaccgacttcaagggcaagacggtgtggttcgtgccgtccatcaaggccgggaacgacatcgcggcctgcctccggaagaacggcaagaaggtcatccagctgagccgcaagaccttcgactccgagtacgtgaagacccgggccaacgactgggacttcgtggtcaccacggacatcagcgagatgggcgccaacttcaaggccgagcgcgtgatcgacccccggcgctgcatgaagcccgtgatcctgaccgacggggaggagcgggtcatcctcgcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagacgttcgtcgacctgatgcggcgcggcgacctccccgtgtggctggcctacaaggtggccgccgaggggatcaactacgcggaccggaagtggtgcttcgacggcatcaagaacaaccagatcctggaggagaacatggaggtcgagatctggaccaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccacgttcatgacccagaaggcccggaacgccctggacaacctcgccgtgctgcacaccgccgaggccgggggccgcgcctacaaccacgccctgagcgagctccccgagaccctggagacgctgctcctgctgaccctcctggccaccgtcaccgggggcatcttcctgttcctcatgtccggcaaggggatcggcaagatgaccctggggatgtgctgcatcatcacggccagcatcctgctctggtacgcgcagatccagccgcactggatcgccgcctccatcatcctggagttcttcctgatcgtgctcctgatccccgagcccgagaagcagcggacgccccaggacaaccagctgacctacgtggtcatcgccatcctcaccgtggtggccgcgacgatggccaacgagatgggcttcctggagaagaccaagaaggacctggggctcggcagcatcaccacccaggagagcgagtccaacatcctggacatcgacctgcgcccggccagcgcctggacgctctacgccgtcgcgaccaccttcgtgacccccatgctgcggcactccatcgagaacagctccgtgaacgtcagcctgacggccatcgccaaccaggccaccgtgctcatgggcctggggaagggctggcccctgtccaagatggacatcggggtgcccctcctggcgatcggctgctacagccaggtcaacccgatcaccctgaccgccgccctcctgctgctcgtggcccactacgccatcatcgggcccggcctgcaggcgaaggccacgcgcgaggcccagaagcgggccgccgcgggcatcatgaagaaccccaccgtggacgggatcaccgtcatcgacctggagcccatcccgtacgaccccaagttcgagaagcagctcggccaggtgatgctgctgatcctctgcgtgacccaggtcctgatgatgcgcacgacctgggccctgtgcgaggccctcaccctggccaccgggcccatctccacgctgtgggagggcaaccccgggcggttctggaacaccaccatcgccgtgagcatggcgaacatcttccgcggctcctacctcgccggcgccgggctgctgttcagcatcatgaagaacaccacgtccacccgccggggcaccgggaacatcggcgagaccctcggcgagaagtggaagtcccgcctgaacgccctggggaagtccgagttccagatctacaagaagtccggcatccaggaggtggaccggacgctcgcgaaggaggggatcaagcgcggcgagaccgaccaccacgccgtctcccgggggagcgccaagctgcgctggttcgtggagcggaacatggtgaccccggagggcaaggtcgtggacctgggctgcgggcgcggcgggtggtcctactactgcggcgggctcaagaacgtgcgggaggtcaagggcctgaccaagggcgggcccggccacgaggagcccatccccatgagcacgtacgggtggaacctggtgcgcctccagagcggcgtggacgtcttcttcaccccgcccgagaagtgcgacaccctgctgtgcgacatcggggagtccagccccaaccccaccatcgaggccggccggaccctccgcgtgctgaacctggtggagaactggctcaacaacaacacgcagttctgcatcaaggtcctgaacccgtacatgccctccgtgatcgagaagatggaggccctgcagcggcagtacggcggggcgctcgtgcgcaaccccctgagccggaactccacccacgagatgtactgggtcagcaacgccaccggcaacatcgtgtccagcgtgaacatgatctcccgcatgctgatcaaccggttcaccatgaagcacaagaaggccacgtacgagccggacgtcgacctggggagcggcacccgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagacggggagcgcctccagcatggtgaacggcgtggtccgcctgctgaccaagccctgggacgtggtgccgatggtcacccagatggcgatgaccgacacgacccccttcgggcagcagcgcgtgttcaaggagaaggtggacacccggacccaggagcccaaggagggcacgaagaagctcatgaagatcaccgccgagtggctgtggaaggagctgggcaagaagaagacgccccgcatgtgcacccgggaggagttcacgaagaaggtccgctccaacgccgccctcggggccatcttcaccgacgagaacaagtggaagtccgcgcgggaggccgtggaggacggccgcttctgggagctggtggaccgggagcgcaacctgcacctcgaggggaagtgcgagacctgcgtctacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtggagggggagggcctgcaccggctgggctacatcctccgcgacgtcgggaagaaggagggcggggccatgtacgccgacgacaccgccggctgggacacgcggatcaccctggaggacctgaagaacgaggagatggtgaccaaccacatgaagggggagcacaagaagctcgcggaggccatcttcaagctgacctaccagaacaaggtggtccgcgtgcagcggccgacgccccgcggcaccgtgatggacatcatcagccggcgcgaccagcggggctccgggcaggtcggcacctacgggctgaacaccttcacgaacatggaggcccagctcatccgccagatggagggcgagggcatcttcaagagcatccagcacctgaccgccaccgaggagatcgccgtgcagaactggctggcgcgcgtggggcgggagcgcctctcccggatggccatcagcggcgacgactgcgtcgtgaagcccatcgacgaccgcttcgcctccgccctgaccgccctgaacgacatggggaaggtgcggaaggacatccagcagtgggagcccagccgcggctggaacgactggacgcaggtcccgttctgctcccaccacttccacgagctcgtgatgaaggacgggcgggtgctggtcgtgccctgccgcaaccaggacgagctgatcggccgggcgcgcatcagccagggcgccgggtggtccctcaaggagaccgcctgcctgggcaagagctacgcccagatgtggaccctgatgtacttccaccggcgcgacctccggctggccgcgaacgccatctgctccgccgtgcccagccactgggtccccacctcccgcaccacgtggagcatccacgccaagcacgagtggatgaccaccgaggacatgctggcggtgtggaaccgggtgtggatccaggagaacccgtggatggaggacaagacccccgtcgagtcctgggaggaggtgccctacctcgggaagcgcgaggaccagtggtgcggcagcctgatcgggctgacgagccgggccacctgggccaagaacatccagaccgccatcaaccaggtgcgctccctcatcggcaacgaggagtacaccgactacatgcccagcatgaagcggttccgccgcgaggaggaggaggccggcgtcctgtggtga

SEQ ID NO: 9203 - RNA, 9876 nt, synthetic construct
  misc_feature 1..9876: note = derived and/or modified CDS sequence (opt1) from DENV-2__EU596495__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctcttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccggcaaggacagccccgtgaacatcgaggcggagccgcccttcggggactcctacatcatcatcggcgtggagccggggcagctgaagctcaactggttcaagaagggcagctccatcggccagatgttcgagacgaccatgcgcggggccaagcggatggccatcctgggcgacaccgcctgggacttcgggagcctgggcggggtcttcacctccatcggcaaggccctccaccaggtgttcggcgcgatctacggggccgccttcagcggcgtgtcctggacgatgaagatcctgatcggggtcatcatcacctggatcggcatgaacagccgctccaccagcctgtccgtgagcctggtgctcgtcggggtggtgaccctgtacctgggcgccgtcgtgcaggcggactccggctgcgtggtcagctggaagaacaaggagctcaagtgcgggtccggcatcttcatcacggacaacgtgcacacctggaccgagcagtacaagttccagcccgagagccccagcaagctggcctccgccatccagaaggcccacgaggaggggatctgcggcatccggagcgtgacccgcctggagaacctcatgtggaagcagatcacgcccgagctgaaccacatcctgtccgagaacgaggtcaagctcaccatcatgaccggggacatcaagggcatcatgcaggccggcaagcggagcctgcgcccgcagcccaccgagctgaagtactcctggaagacgtgggggaaggcgaagatgctcagcaccgagtcccacaaccagaccttcctgatcgacggccccgagaccgccgagtgcccgaacacgaaccgggcctggaacagcctggaggtggaggactacgggttcggcgtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggggtcctggagagcgagatgatcatccccaagaacttcgccggccccgtgtcccagcacaactaccgcccggggtaccacacgcagaccgcgggcccctggcacctcgggaagctggagatggacttcgacttctgcgagggcaccaccgtggtcgtgacggaggactgcggcaaccgggggcccagcctgcgcaccaccaccgccagcggcaagctcatcacggagtggtgctgccggtcctgcaccctgcccccgctgcgctaccgcggggaggacggctgctggtacgggatggagatccgccccctcaaggagaaggaggagaacctggtgaacagcctggtcaccgccggccacggccagatcgacaacttctccctcggggtgctgggcatggccctgttcctcgaggagatgctgcggacccgcatcgggacgaagcacgcgatcctgctcgtggccgtcagcttcgtgaccctgatcaccggcaacatgtccttccgggacctggggcgcgtgatggtcatggtgggcgccaccatgacggacgacatcggcatgggggtgacctacctcgccctgctggccgcgttcaaggtccgccccaccttcgccgccggcctcctgctgcggaagctcaccagcaaggagctgatgatggccacgatcgggatcgccctgctctcccagagcaccatccccgagaccatcctggagctgaccgacgcgctcgccctgggcatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtggggatggtgagcatcctcgcctccagcctgctgaagaacgacatccccatgacgggccccctcgtcgccggcgggctgctgaccgtgtgctacgtgctcaccgggcggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccgggctcctggtgatcagcggcgtgttcccggtctccatccccatcaccgcggccgcctggtacctgtgggaggtgaagaagcagcgcgccggggtgctctgggacgtccccagcccgccgcccgtggagaaggccgagctggaggacggcgcgtaccggatcaagcagcgcgggatcctgggctactcccagatcggcgccggggtgtacaaggagggcaccttccacacgatgtggcacgtcacccgcggggcggtgctcatgcaccggggcaagcggatcgagcccagctgggccgacgtgaagaaggacctgatctcctacgggggcggctggaagctggagggggagtggaaggagggcgaggaggtccaggtgctcgccctggagcccgggaagaacccccgcgcggtgcagaccaagcccggcatcttcaagaccaacacggggaccatcggcgccgtcagcctggacttctcccccggcaccagcgggtcccccatcgtggaccggaagggcaaggtggtcgggctctacggcaacggcgtggtgacccgcagcggggcctacgtctccgccatcgcgcagacggagaagtccatcgaggacaaccccgagatcgaggacgacatcttccggaagaagcgcctgaccatcatggacctgcaccccggcgccgggaagaccaagcggtacctccccgccatcgtgcgcgaggccatcaagcggggcctgcgcaccctgatcctggccccgacgcgcgtggtcgcggccgagatggaggaggccctccgggggctgcccatccgctaccagacccccgccatcaagaccgagcacaccggccgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggggaggccgcgggcatcttcatgacggccacgccgcccgggtcccgcgacccgttcccccagagcaacgcccccatcatggacgaggagcgggagatccccgagcgctcctggaacagcggccacgagtgggtgaccgacttcaaggggaagaccgtctggttcgtgccgtccatcaaggccggcaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggggccaacttcaaggccgagcgcgtcatcgacccccggcgctgcatgaagcccgtgatcctgacggacggcgaggagcgggtgatcctcgcggggcccatgccggtcacccactccagcgccgcccagcgccggggccgcatcgggcgcaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgggagaaggtggacgcgatcgacggggagtaccgcctgcggggcgaggcccgcaagaccttcgtggacctgatgcggcgcggggacctccccgtctggctggcctacaaggtggccgccgagggcatcaactacgcggaccggaagtggtgcttcgacgggatcaagaacaaccagatcctggaggagaacatggaggtggagatctggacgaaggagggcgagcgcaagaagctcaagccgcggtggctggacgcccgcatctacagcgaccccctggccctcaaggagttcaaggagttcgccgcgggccggaagtccctgaccctgaacctcatcaccgagatggggcgcctgcccaccttcatgacgcagaaggcccggaacgccctggacaacctcgccgtcctgcacaccgccgaggcgggcgggcgcgcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatggggttcctggagaagacgaagaaggacctgggcctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatggggctgggcaaggggtggcccctgtccaagatggacatcggcgtgcccctcctggcgatcgggtgctacagccaggtgaacccgatcaccctgaccgccgccctcctgctgctcgtcgcccactacgccatcatcggccccggcctgcaggcgaaggccacccgcgaggcccagaagcgggccgccgcggggatcatgaagaaccccacggtggacggcatcaccgtgatcgacctggagcccatcccgtacgaccccaagttcgagaagcagctcgggcaggtcatgctgctgatcctctgcgtgacccaggtgctgatgatgcgcaccacgtgggccctgtgcgaggccctcaccctggccaccggccccatctccaccctgtgggaggggaaccccggccggttctggaacacgaccatcgccgtcagcatggcgaacatcttccgcggctcctacctcgccggggccggcctgctgttcagcatcatgaagaacaccacctccacgcgccgggggaccggcaacatcggcgagaccctcggggagaagtggaagtcccgcctgaacgccctgggcaagtccgagttccagatctacaagaagtccgggatccaggaggtggaccggaccctcgcgaaggagggcatcaagcgcggggagacggaccaccacgccgtgtcccggggcagcgccaagctgcgctggttcgtcgagcggaacatggtgaccccggagggcaaggtggtcgacctggggtgcggccgcgggggctggtcctactactgcgggggcctcaagaacgtgcgggaggtgaagggcctgaccaagggcgggcccgggcacgaggagcccatccccatgagcacctacggctggaacctggtccgcctccagagcggggtggacgtgttcttcacgccgcccgagaagtgcgacaccctgctgtgcgacatcggcgagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacgggggcgcgctcgtgcgcaaccccctgagccggaactccacgcacgagatgtactgggtgagcaacgccaccgggaacatcgtctccagcgtgaacatgatctcccgcatgctgatcaaccggttcaccatgaagcacaagaaggccacctacgagccggacgtggacctgggcagcgggacgcgcaacatcggcatcgagtccgagatccccaacctcgacatcatcggcaagcggatcgagaagatcaagcaggagcacgagatcagctggcactacgaccaggaccacccctacaagacctgggcctaccacgggtcctacgagaccaagcagaccggcagcgcctccagcatggtcaacggggtggtgcgcctgctgacgaagccctgggacgtcgtgccgatggtgacccagatggcgatgaccgacaccacgcccttcggccagcagcgcgtcttcaaggagaaggtggacacccggacccaggagcccaaggagggcaccaagaagctcatgaagatcacggccgagtggctgtggaaggagctggggaagaagaagacgccccgcatgtgcacccgggaggagttcaccaagaaggtgcgctccaacgccgccctcggcgccatcttcacggacgagaacaagtggaagtccgcgcgggaggccgtcgaggacgggcgcttctgggagctggtggaccgggagcgcaacctgcacctcgagggcaagtgcgagacctgcgtgtacaacatgatggggaagcgggagaagaagctgggcgagttcggcaaggccaaggggtcccgcgccatctggtacatgtggctgggcgcgcggttcctcgagttcgaggccctggggttcctgaacgaggaccactggttcagccgcggcaacagcctctccggggtcgagggcgagggcctgcaccggctggggtacatcctccgcgacgtgggcaagaaggagggcggggccatgtacgccgacgacaccgccgggtgggacacccggatcacgctggaggacctgaagaacgaggagatggtcaccaaccacatgaagggcgagcacaagaagctcgcggaggccatcttcaagctgacctaccagaacaaggtggtgcgcgtccagcggccgacgccccgcggcacggtgatggacatcatcagccggcgcgaccagcgggggtccggccaggtggggacctacggcctgaacaccttcaccaacatggaggcccagctcatccgccagatggagggcgaggggatcttcaagagcatccagcacctgacggccaccgaggagatcgccgtccagaactggctggcgcgcgtgggccgggagcgcctctcccggatggccatcagcggggacgactgcgtggtcaagcccatcgacgaccgcttcgcctccgccctgaccgccctgaacgacatgggcaaggtgcggaaggacatccagcagtgggagcccagccgcgggtggaacgactggacccaggtgccgttctgctcccaccacttccacgagctcgtcatgaaggacggccgggtgctggtggtcccctgccgcaaccaggacgagctgatcggccgggcgcgcatcagccagggggccggctggtccctcaaggagacggcctgcctgggcaagagctacgcccagatgtggaccctgatgtacttccaccggcgcgacctccggctggccgcgaacgccatctgctccgccgtgcccagccactgggtgcccacctcccgcaccacctggagcatccacgccaagcacgagtggatgacgaccgaggacatgctggcggtctggaaccgggtgtggatccaggagaacccgtggatggaggacaagacccccgtggagtcctgggaggaggtcccctacctcggcaagcgcgaggaccagtggtgcgggagcctgatcggcctgaccagccgggccacgtgggccaagaacatccagaccgccatcaaccaggtgcgctccctcatcggcaacgaggagtacaccgactacatgcccagcatgaagcggttccgccgcgaggaggaggaggccggggtgctgtggtga

SEQ ID NO: 9204 - RNA, 9876 nt, synthetic construct
  misc_feature 1..9876: note = derived and/or modified CDS sequence (opt1) from DENV-2__EU596497__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccatcaccgagtcccggtgcccgacccagggcgagcccagcctgaacgaggagcaggacaagcgcttcatctgcaagcactccatggtggaccggggctgggggaacggctgcgggctgttcggcaagggcgggatcgtcacgtgcgcgatgttcacgtgcaagaagaacatggagggcaaggtggtgcagcccgagaacctggagtacaccatcgtcatcacgccccacagcggggaggagcacgccgtgggcaacgacacggggaagcacggcaaggagatcaagatcaccccgcagtccagcatcaccgaggccgagctgaccgggtacggcaccgtgacgatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagaccctggtgacgttcaagaacccccacgcgaagaagcaggacgtcgtggtcctcgggtcccaggagggcgccatgcacaccgccctgaccggggccaccgagatccagatgagcagcggcaacctcctgttcacgggccacctgaagtgccgcctgcggatggacaagctccagctgaaggggatgtcctacagcatgtgcaccggcaagttcaagatcgtgaaggagatcgccgagacccagcacgggaccatcgtgatccgcgtccagtacgagggcgacggctccccctgcaagatccccttcgagatcacggacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggaccatgaagatcctgatcggcgtcatcatcacgtggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtgttcacgaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagctacaccctgtggtccaacggcgtcctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtggtcgtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcaccaagcacgcgatcctgctcgtggccgtcagcttcgtgacgctgatcaccgggaacatgtccttccgggacctgggccgcgtgatggtcatggtgggggccaccatgaccgacgacatcggcatgggcgtgacgtacctcgccctgctggccgcgttcaaggtccgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtgctgaagatcgtgcgcaacatggagaagtaccagctcgccgtcaccatcatggccatctcctgcgtgccgaacgccgtgatcctgcagaacgcgtggaaggtcagctgcacgatcctggccgccgtgtccgtcagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtgggcatggtgagcatcctcgcctccagcctgctgaagaacgacatccccatgaccgggcccctcgtcgcgggcgggctgctgacggtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagaccctgacgatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacaccatgtggcacgtcacgcggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacaccggcacgatcggggccgtcagcctggacttctcccccggcaccagcggctcccccatcgtggaccggaaggggaaggtggtcggcctctacgggaacggcgtggtgacccgcagcggcgcctacgtctccgccatcgcgcagaccgagaagtccatcgaggacaaccccgagatcgaggacgacatcttccggaagaagcgcctgacgatcatggacctgcaccccggggccggcaagaccaagcggtacctccccgccatcgtgcgcgaggccatcaagcgggggctgcgcaccctgatcctggccccgacccgcgtggtcgcggccgagatggaggaggccctccggggcctgcccatccgctaccagacgcccgccatcaagaccgagcacaccgggcgggagatcgtggacctgatgtgccacgccaccttcacgatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagaccttcgactccgagtacgtcaagacgcgggccaacgactgggacttcgtggtgaccaccgacatcagcgagatgggcgccaacttcaaggccgagcgcgtcatcgacccccggcgctgcatgaagcccgtgatcctgaccgacggggaggagcgggtgatcctcgcgggccccatgccggtcacgcactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggaccaaggagggggagcgcaagaagctcaagccgcggtggctggacgcccgcatctacagcgaccccctggccctcaaggagttcaaggagttcgccgcgggccggaagtccctgacgctgaacctcatcaccgagatgggccgcctgcccaccttcatgacccagaaggcccggaacgccctggacaacctcgccgtcctgcacacggccgaggccgggggccgcgcctacaaccacgccctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacgtacgtggtgatcgccatcctcaccgtcgtggccgcgaccatggccaacgagatgggcttcctggagaagaccaagaaggacctggggctcggcagcatcacgacccaggagagcgagtccaacatcctggacatcgacctgcgcccggccagcgcctggaccctctacgccgtggcgaccacgttcgtcacccccatgctgcggcactccatcgagaacagctccgtgaacgtgagcctgaccgccatcgccaaccaggccaccgtcctcatgggcctggggaagggctggcccctgtccaagatggacatcggggtgcccctcctggcgatcggctgctacagccaggtgaacccgatcacgctgaccgccgccctcctgctgctcgtcgcccactacgccatcatcgggcccggcctgcaggcgaaggccacccgcgaggcccagaagcgggccgccgcgggcatcatgaagaaccccaccgtggacgggatcacggtgatcgacctggagcccatcccgtacgaccccaagttcgagaagcagctcggccaggtcatgctgctgatcctctgcgtgacccaggtgctgatgatgcgcaccacctgggccctgtgcgaggccctcacgctggccaccgggcccatctccaccctgtgggagggcaaccccgggcggttctggaacaccacgatcgccgtcagcatggcgaacatcttccgcggctcctacctcgccggcgccgggctgctgttcagcatcatgaagaacaccacctccacccgccggggcacggggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagaccgaccaccacgccgtgtcccgggggagcgccaagctgcgctggttcgtcgagcggaacatggtgacgccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacctacgggtggaacctggtccgcctccagagcggcgtggacgtgttcttcaccccgcccgagaagtgcgacacgctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacccacgagatgtactgggtgagcaacgccacgggcaacatcgtctccagcgtgaacatgatctcccgcatgctgatcaaccggttcaccatgaagcacaagaaggccacctacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacgtgggcctaccacggctcctacgagaccaagcagaccgggagcgcctccagcatggtcaacggcgtggtgcgcctgctgaccaagccctgggacgtcgtgccgatggtgacgcagatggcgatgaccgacaccacccccttcgggcagcagcgcgtcttcaaggagaaggtggacacgcggacccaggagcccaaggagggcaccaagaagctcatgaagatcaccgccgagtggctgtggaaggagctgggcaagaagaagacgccccgcatgtgcacccgggaggagttcaccaagaaggtgcgctccaacgccgccctcggggccatcttcaccgacgagaacaagtggaagtccgcgcgggaggccgtcgaggacggccgcttctgggagctggtggaccgggagcgcaacctgcacctcgaggggaagtgcgagacgtgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacccggatcaccctggaggacctgaagaacgaggagatggtcacgaaccacatgaagggggagcacaagaagctcgcggaggccatcttcaagctgacctaccagaacaaggtggtgcgcgtccagcggccgacgccccgcggcaccgtgatggacatcatcagccggcgcgaccagcggggctccggccaggtgggcacgtacgggctgaacaccttcaccaacatggaggcccagctcatccgccagatggagggcgagggcatcttcaagagcatccagcacctgaccgccacggaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagaccgcctgcctgggcaagagctacgcccagatgtggacgctgatgtacttccaccggcgcgacctccggctggccgcgaacgccatctgctccgccgtgcccagccactgggtgcccacctcccgcaccacctggagcatccacgccaagcacgagtggatgaccacggaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacctgggccaagaacatccagacggccatcaaccaggtgcgctccctcatcggcaacgaggagtacaccgactacatgcccagcatgaagcggttccgccgcgaggaggaggaggccggcgtgctgtggtga

SEQ ID NO: 9205 - RNA, 9876 nt, synthetic construct
  misc_feature 1..9876: note = derived and/or modified CDS sequence (opt1) from DENV-2__EU569695__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccgtcgccaaccaggccacggtgctcatgggcctggggaagggctggcccctgtccaagatggacatcggggtgcccctcctggcgatcggctgctacagccaggtcaacccgatcaccctgaccgccgccctcctgctgctcgtggcccactacgccatcatcgggcccggcctgcaggcgaaggccacccgcgaggcccagaagcgggccgccgcgggcatcatgaagaaccccacggtggacgggatcaccgtcatcgacctggagcccatcccgtacgaccccaagttcgagaagcagctcggccaggtgatgctgctgatcctctgcgtgacccaggtcctgatgatgcgcaccacgtgggccctgtgcgaggccctcaccctggccaccgggcccatctccaccctgtgggagggcaaccccgggcggttctggaacacgaccatcgccgtgagcatggcgaacatcttccgcggctcctacctcgccggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagacggaccaccacgccgtctcccgggggagcgccaagctgcgctggttcgtggagcggaacatggtgaccccggagggcaaggtcgtggacctgggctgcgggcgcggcgggtggtcctactactgcggcgggctcaagaacgtgcgggaggtcaagggcctgaccaagggcgggcccggccacgaggagcccatccccatgagcacctacgggtggaacctggtgcgcctccagagcggcgtggacgtcttcttcacgccgcccgagaagtgcgacaccctgctgtgcgacatcggggagtccagccccaaccccaccatcgaggccggccggaccctccgcgtgctgaacctggtggagaactggctcaacaacaacacccagttctgcatcaaggtcctgaacccgtacatgccctccgtgatcgagaagatggaggccctgcagcggcagtacggcggggcgctcgtgcgcaaccccctgagccggaactccacgcacgagatgtactgggtcagcaacgccaccggcaacatcgtgtccagcgtgaacatgatctcccgcatgctgatcaaccggttcaccatgaagcacaagaaggccacctacgagccggacgtcgacctggggagcggcacgcgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagaccgggagcgcctccagcatggtgaacggcgtggtccgcctgctgacgaagccctgggacgtggtgccgatggtcacccagatggcgatgaccgacaccacgcccttcgggcagcagcgcgtgttcaaggagaaggtggacacccggacccaggagcccaaggagggcaccaagaagctcatgaagatcacggccgagtggctgtggaaggagctgggcaagaagaagacgccccgcatgtgcacccgggaggagttcaccaagaaggtccgctccaacgccgccctcggggccatcttcacggacgagaacaagtggaagtccgcgcgggaggccgtggaggacggccgcttctgggagctggtggaccgggagcgcaacctgcacctcgaggggaagtgcgagacctgcgtctacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtggagggggagggcctgcaccggctgggctacatcctccgcgacgtcgggaagaaggagggcggggccatgtacgccgacgacaccgccggctgggacacccggatcacgctggaggacctgaagaacgaggagatggtgaccaaccacatgaagggggagcacaagaagctcgcggaggccatcttcaagctgacctaccagaacaaggtggtccgcgtgcagcggccgacgccccgcggcacggtgatggacatcatcagccggcgcgaccagcggggctccgggcaggtcggcacctacgggctgaacaccttcaccaacatggaggcccagctcatccgccagatggagggcgagggcatcttcaagagcatccagcacctgacggccaccgaggagatcgccgtgcagaactggctggcgcgcgtggggcgggagcgcctctcccggatggccatcagcggcgacgactgcgtcgtgaagcccatcgacgaccgcttcgcctccgccctgaccgccctgaacgacatggggaaggtgcggaaggacatccagcagtgggagcccagccgcggctggaacgactggacccaggtcccgttctgctcccaccacttccacgagctcgtgatgaaggacgggcgggtgctggtcgtgccctgccgcaaccaggacgagctgatcggccgggcgcgcatcagccagggcgccgggtggtccctcaaggagacggcctgcctgggcaagagctacgcccagatgtggaccctgatgtacttccaccggcgcgacctccggctggccgcgaacgccatctgctccgccgtgcccagccactgggtccccacctcccgcaccacctggagcatccacgccaagcacgagtggatgacgaccgaggacatgctggcggtgtggaaccgggtgtggatccaggagaacccgtggatggaggacaagacccccgtcgagtcctgggaggaggtgccctacctcgggaagcgcgaggaccagtggtgcggcagcctgatcgggctgaccagccgggccacgtgggccaagaacatccagaccgccatcaaccaggtgcgctccctcatcggcaacgaggagtacaccgactacatgcccagcatgaagcggttccgccgcgaggaggaggaggccggcgtcctgtggtga

SEQ ID NO: 9206 - RNA, 9876 nt, synthetic construct
  misc_feature 1..9876: note = derived and/or modified CDS sequence (opt1) from DENV-2__EU482623__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccaggagagcaactggatccagaaggagacgctggtgaccttcaagaacccccacgcgaagaagcaggacgtcgtggtcctcggctcccaggagggggccatgcacaccgccctgaccggcgccacggagatccagatgagcagcgggaacctcctgttcaccggccacctgaagtgccgcctgcggatggacaagctccagctgaagggcatgtcctacagcatgtgcaccgggaagttcaagatcgtgaaggagatcgccgagacccagcacggcacgatcgtgatccgcgtccagtacgagggggacggctccccctgcaagatccccttcgagatcaccgacctggagaagcggcacgtgctcggccgcctgatcaccgtgaacccgatcgtcaccgagaaggacagccccgtgaacatcgaggcggagccgcccttcggggactcctacatcatcatcggcgtggagccggggcagctgaagctcaactggttcaagaagggcagctccatcgggcagatgttcgagacgaccatgcgcggcgccaagcggatggccatcctgggcgacaccgcctgggacttcgggagcctgggcggggtcttcacctccatcggcaaggccctccaccaggtgttcggggcgatctacggcgccgccttcagcggcgtgtcctggacgatgaagatcctgatcggggtcatcatcacctggatcggcatgaacagccgctccaccagcctgtccgtgagcctggtgctcgtcggggtggtgaccctgtacctgggcgccgtcgtgcaggcggactccgggtgcgtggtcagctggaagaacaaggagctcaagtgcggctccggcatcttcatcacggacaacgtgcacacctggaccgagcagtacaagttccagcccgagagccccagcaagctggcctccgccatccagaaggcccacgaggaggggatctgcggcatccggagcgtgacccgcctggagaacctcatgtggaagcagatcacgcccgagctgaaccacatcctgtccgagaacgaggtcaagctcaccatcatgaccggggacatcaagggcatcatgcaggccgggaagcggagcctgcgcccgcagcccaccgagctgaagtactcctggaagacgtggggcaaggcgaagatgctcagcaccgagtcccacaaccagaccttcctgatcgacggccccgagaccgccgagtgcccgaacacgaaccgggcctggaacagcctggaggtggaggactacgggttcggcgtgttcaccaccaacatctggctcaagctgcgcgagaagcaggacgtcttctgcgactccaagctgatgagcgccgccatcaaggacaaccgggcggtgcacgccgacatggggtactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccggccccgtgtcccagcacaactaccgcccggggtaccacacgcagaccgcgggcccctggcacctcgggaagctggagatggacttcgacttctgcgagggcaccaccgtggtcgtgacggaggactgcgggaaccggggccccagcctgcgcaccaccaccgccagcggcaagctcatcacggagtggtgctgccggtcctgcaccctgcccccgctgcgctaccgcggggaggacggctgctggtacgggatggagatccgccccctcaaggagaaggaggagaacctggtgaacagcctggtcaccgccggccacgggcagatcgacaacttctccctcggcgtgctgggcatggccctgctcctggaggagatgctgcggacccgcatcgggacgaagcacgcgatcctcctggtggccgtcagcttcgtgaccctgatcaccggcaacatgtccttccgggacctcgggcgcgtgatggtcatggtgggcgccaccatgacggacgacatcgggatgggcgtgacctacctggccctgctcgccgcgttcaaggtccgccccaccttcgccgccggcctgctgctccggaagctgaccagcaaggagctgatgatggccacgatcgggatcgccctcctgtcccagagcaccatccccgagaccatcctggagctcaccgacgcgctggccctgggcatgatggtgctcaagatcgtgcgcaacatggagaagtaccagctggccgtcacgatcatggccatctcctgcgtgccgaacgccgtgatcctgcagaacgcgtggaaggtcagctgcaccatcctcgccgccgtgtccgtcagccccctgctgctcacctccagccagcagaaggccgactggatccccctggcgctgaccatcaaggggctcaaccccacggccatcttcctgaccaccctgtcccggaccagcaagaagcgctcctggccgctcaacgaggccatcatggccgtgggcatggtgagcatcctggcctccagcctgctcaagaacgacatccccatgacgggccccctggtcgccggcgggctgctcaccgtgtgctacgtgctgaccgggcggagcgccgacctggagctcgagcgcgccgccgacgtcaagtgggaggaccaggccgagatctccgggagctcccccatcctgagcatcaccatctccgaggacgggagcatgtccatcaagaacgaggaggaggagcagacgctgaccatcctcatccggaccggcctgctggtgatcagcggcgtgttcccggtctccatccccatcaccgcggccgcctggtacctctgggaggtgaagaagcagcgcgccggggtgctgtgggacgtccccagcccgccgcccgtggagaaggccgagctggaggacggcgcgtaccggatcaagcagcgcgggatcctcggctactcccagatcggggccggcgtgtacaaggagggcaccttccacacgatgtggcacgtcacccgcggggcggtgctgatgcaccggggcaagcggatcgagcccagctgggccgacgtgaagaaggacctgatctcctacgggggcgggtggaagctcgagggcgagtggaaggagggcgaggaggtccaggtgctggccctggagcccgggaagaacccccgcgcggtgcagaccaagcccggcatcttcaagaccaacagcgggacgatcggcgccgtctccctcgacttcagccccgggacctccggcagccccatcgtggaccggaagggcaaggtggtcgggctgtacggcaacggggtggtgacccgctccggcgcctacgtcagcgccatcgcgcagaccgagaagtccatcgaggacaaccccgagatcgaggacgacatcttccggaagaagcgcctgacgatcatggacctccaccccggcgccgggaagaccaagcggtacctgcccgccatcgtgcgcgaggccatcaagcggggcctgcgcaccctgatcctcgccccgacccgcgtggtcgcggccgagatggaggaggccctgcgggggctgcccatccgctaccagacgcccgccatcaagaccgagcacaccggccgggagatcgtggacctcatgtgccacgccaccttcacgatgcgcctgctgtcccccgtgcgggtcccgaactacaacctcatcatcatggacgaggcgcacttcaccgaccccgccagcatcgccgcccgcgggtacatctccacccgggtggagatgggcgaggccgcgggcatcttcatgaccgccacgccgcccgggagccgcgacccgttcccccagtccaacgcccccatcatggacgaggagcgggagatccccgagcgcagctggaactccggccacgagtgggtgaccgacttcaaggggaagaccgtctggttcgtgccgagcatcaaggccggcaacgacatcgcggcctgcctgcggaagaacgggaagaaggtgatccagctgtcccgcaagaccttcgacagcgagtacgtcaagacgcgggccatcgactgggacttcgtggtgaccaccgacatctccgagatgggcgccaacttcaaggccgagcgcgtcatcgacccccggcgctgcatgaagcccgtgatcctcaccgacggcgaggagcgggtgatcctggcggggcccatgccggtcacgcacagctccgccgcccagcgccggggccgcatcgggcgcaaccccaagaacgagaacgaccagtacatctacatgggcgagcccctggagaacgacgaggactgcgcccactggaaggaggccaagatgctcctggacaacatcaacacccccgaggggatcatcccgagcatgttcgagcccgagcgggagaaggtggacgcgatcgacggcgagtaccgcctgcggggcgaggcccgcaagaccttcgtggacctcatgcggcgcggggacctgcccgtctggctggcctacaaggtggccgccgagggcatcaactacgcggaccggaagtggtgcttcgacgggatcaagaacaaccagatcctcgaggagaacatggaggtggagatctggaccaaggagggcgagcgcaagaagctgaagccgcggtggctggacgcccgcatctactccgaccccctcgccctgaaggagttcaaggagttcgccgcggggcgcaagagcctgacgctcaacctgatcaccgagatgggccgcctgcccaccttcatgacccagaaggcccggaacgccctcgacaacctggccgtcctgcacacggccgaggcgggcgggcgcgcctacaaccacgccctctccgagctgcccgagaccctggagaccctcctgctgctcaccctgctggccacggtgaccggcgggatcttcctcttcctgatgagcggcaagggcatcgggaagatgaccctgggcatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacgtacgtggtgatcgccatcctgaccgtcgtggccgcgaccatggccaacgagatggggttcctggagaagaccaagaaggacctcggcctggggagcatcacgacccaggagtccgagagcaacatcctggacatcgacctccgcccggcctccgcctggaccctgtacgccgtggcgaccacgttcgtcacccccatgctgcggcacagcatcgagaactccagcgtgaacgtgtccctcaccgccatcgccaaccaggccaccgtcctgatgggcctgggcaaggggtggcccctcagcaagatggacatcggcgtgcccctgctggcgatcgggtgctactcccaggtgaacccgatcacgctcaccgccgccctgctgctcctggtcgcccactacgccatcatcggccccgggctgcaggcgaaggccacccgcgaggcccagaagcgggccgccgcgggcatcatgaagaaccccaccgtggacggcatcacggtgatcgacctcgagcccatcccgtacgaccccaagttcgagaagcagctggggcaggtcatgctgctcatcctgtgcgtgacccaggtgctgatgatgcgcaccacctgggccctctgcgaggccctgacgctggccaccggccccatcagcaccctctgggaggggaaccccggccggttctggaacaccacgatcgccgtctccatggcgaacatcttccgcgggagctacctggccggcgccggcctcctcttctccatcatgaagaacaccaccagcacccgccgggggacgggcaacatcggggagaccctgggcgagaagtggaagtcccgcctgaacgccctcggcaagagcgagttccagatctacaagaagtccgggatccaggaggtggaccggaccctggcgaaggagggcatcaagcgcggggagaccgaccaccacgccgtgagccggggctccgccaagctgcgctggttcgtcgagcggaacatggtgacgccggaggggaaggtggtcgacctcggctgcggccgcgggggctggagctactactgcgggggcctgaagaacgtgcgggaggtgaaggggctgaccaagggcggccccgggcacgaggagcccatccccatgagcacctacggctggaacctcgtccgcctgcagtccggggtggacgtgttcttcaccccgcccgagaagtgcgacacgctgctctgcgacatcggcgagagctcccccaaccccaccatcgaggccgggcggaccctgcgcgtcctgaacctcgtggagaactggctgaacaacaacacccagttctgcatcaaggtgctgaacccgtacatgcccagcgtcatcgagaagatggaggccctccagcggcagtacggcggcgcgctggtgcgcaaccccctgtcccggaacagcacccacgagatgtactgggtgtccaacgccacggggaacatcgtcagctccgtgaacatgatcagccgcatgctgatcaaccggttcaccatgaagcacaagaaggccacctacgagccggacgtggacctcggctccgggacccgcaacatcggcatcgagagcgagatccccaacctggacatcatcgggaagcggatcgagaagatcaagcaggagcacgagatctcctggcactacgaccaggaccacccctacaagacgtgggcctaccacggcagctacgagaccaagcagaccggctccgccagctccatggtcaacggggtggtgcgcctgctcaccaagccctgggacgtcgtgccgatggtgacgcagatggcgatgaccgacaccacccccttcggccagcagcgcgtcttcaaggagaaggtggacacgcggacccaggagcccaaggaggggaccaagaagctgatgaagatcaccgccgagtggctgtggaaggagctcggcaagaagaagacgccccgcatgtgcacccgggaggagttcaccaagaaggtgcgcagcaacgccgccctgggcgccatcttcaccgacgagaacaagtggaagtccgcgcgggaggccgtcgaggacgggcgcttctgggagctggtggaccgggagcgcaacctccacctggagggcaagtgcgagacgtgcgtgtacaacatgatggggaagcgggagaagaagctgggcgagttcgggaaggccaagggcagccgcgccatctggtacatgtggctcggcgcgcggttcctggagttcgaggccctggggttcctcaacgaggaccactggttcagccgcggcaactccctgagcggggtcgagggcgaggggctgcaccggctcggctacatcctgcgcgacgtgggcaagaaggagggcggcgccatgtacgccgacgacaccgccgggtgggacacccggatcaccctggaggacctcaagaacgaggagatggtcacgaaccacatgaagggcgagcacaagaagctggcggaggccatcttcaagctgacctaccagaacaaggtggtgcgcgtccagcggccgacgccccgggggaccgtgatggacatcatctcccggcgcgaccagcggggcagcggccaggtggggacgtacggcctcaacaccttcaccaacatggaggcccagctgatccgccagatggagggggagggcatcttcaagtccatccagcacctgaccgccacggaggagatcgccgtccagaactggctcgcgcgcgtgggccgggagcgcctgagccggatggccatctccggggacgactgcgtggtcaagcccatcgacgaccgcttcgccagcgccctgaccgccctcaacgacatgggcaaggtgcggaaggacatccagcagtgggagccctcccgcgggtggaacgactggacccaggtgccgttctgcagccaccacttccacgagctggtcatgaaggacggccgggtgctggtggtcccctgccgcaaccaggacgagctcatcgggcgggcgcgcatctcccagggcgccggctggagcctgaaggagaccgcctgcctggggaagtcctacgcccagatgtggacgctcatgtacttccaccggcgcgacctgcggctggccgcgaacgccatctgcagcgccgtgccctcccactgggtgcccaccagccgcaccacctggtccatccacgccaagcacgagtggatgaccacggaggacatgctcgcggtctggaaccgggtgtggatccaggagaacccgtggatggaggacaagacccccgtggagagctgggaggaggtcccctacctgggcaagcgcgaggaccagtggtgcgggagcctgatcggcctcacctcccgggccacctgggccaagaacatccagacggccatcaaccaggtgcgcagcctgatcgggaacgaggagtacaccgactacatgccctccatgaagcggttccgccgcgaggaggaggaggccggcgtgctgtggtga

SEQ ID NO: 9207 - RNA, 9876 nt, synthetic construct
  misc_feature 1..9876: note = derived and/or modified CDS sequence (opt1) from DENV-2__EU569698__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacagcttcccgcagtccaacgcccccatcatggacgaggagcgggagatccccgagcgcagctggaactccgggcacgagtgggtgaccgacttcaagggcaagaccgtctggttcgtgcccagcatcaaggccgggaacgacatcgcggcctgcctccggaagaacggcaagaaggtgatccagctgtcccgcaagacgttcgacagcgagtacgtcaagacccgggccaacgactgggacttcgtggtgaccaccgacatctccgagatgggcgccaacttcaaggccgagcgcgtcatcgacccgcggcgctgcatgaagcccgtgatcctgacggacggggaggagcgggtgatcctcgcgggccccatgcccgtcacccacagctccgccgcccagcgccgggggcgcatcggccgcaacccgaagaacgagaacgaccagtacatctacatgggggagcccctggagaacgacgaggactgcgcccactggaaggaggccaagatgctgctcgacaacatcaacacccccgagggcatcatccccagcatgttcgagccggagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccccggtggctggacgcccgcatctactccgacccgctggccctcaaggagttcaaggagttcgccgcgggccgcaagagcctgaccctgaacctcatcaccgagatgggccgcctgcccaccttcatgacgcagaaggcccggaacgccctggacaacctcgccgtcctgcacaccgccgaggccgggggccgcgcctacaaccacgccctgtccgagctccccgagaccctggagaccctgctcctgctgacgctcctggccaccgtgaccgggggcatcttcctgttcctcatgagcggcaaggggatcggcaagatgaccctggggatgtgctgcatcatcaccgcctccatcctgctctggtacgcgcagatccagccccactggatcgccgccagcatcatcctggagttcttcctgatcgtcctcctgatcccggagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagtccgagagcaacatcctggacatcgacctgcgccccgcctccgcctggaccctctacgccgtggcgacgaccttcgtcaccccgatgctgcggcacagcatcgagaactccagcgtgaacgtgtccctgaccgccatcgccaaccaggccacggtcctcatgggcctggggaagggctggcccctgagcaagatggacatcggggtgcccctcctggcgatcggctgctactcccaggtgaaccccatcaccctgaccgccgccctcctgctgctcgtcgcccactacgccatcatcgggccgggcctgcaggcgaaggccacccgcgaggcccagaagcgggccgccgcgggcatcatgaagaaccccacggtggacgggatcaccgtgatcgacctggagcccatcccctacgacccgaagttcgagaagcagctcggccaggtcatgctgctgatcctctgcgtgacccaggtgctgatgatgcgcaccacgtgggccctgtgcgaggccctcaccctggccaccgggcccatcagcaccctgtgggagggcaaccccgggcggttctggaacacgaccatcgccgtctccatggcgaacatcttccgcggcagctacctcgccggcgccgggctgctgttctccatcatgaagaacaccaccagcacgcgccggggcaccgggaacatcggcgagaccctcggcgagaagtggaagtcccgcctgaacgccctgggcaagagcgagttccagatctacaagaagtccggcatccaggaggtggaccggaccctcgcgaaggaggggatcaagcgcggcgagacggaccaccacgccgtgagccgggggtccgccaagctgcgctggttcgtcgagcggaacatggtgacccccgagggcaaggtggtcgacctgggctgcgggcgcggcgggtggagctactactgcggcgggctcaagaacgtgcgggaggtgaagggcctgaccaagggcgggccgggccacgaggagcccatccccatgagcacctacgggtggaacctggtccgcctccagtccggcgtggacgtgttcttcacgcccccggagaagtgcgacaccctgctgtgcgacatcggggagagctcccccaaccccaccatcgaggccggccggaccctccgcgtcctgaacctggtggagaactggctcaacaacaacacccagttctgcatcaaggtgctgaacccctacatgccgagcgtcatcgagaagatggaggccctgcagcggcagtacggcggggcgctcgtgcgcaaccccctgtcccggaacagcacgcacgagatgtactgggtgtccaacgccaccggcaacatcgtcagctccgtgaacatgatcagccgcatgctgatcaaccggttcaccatgaagcacaagaaggccacctacgagcccgacgtggacctggggtccggcacgcgcaacatcgggatcgagagcgagatcccgaacctcgacatcatcggcaagcggatcgagaagatcaagcaggagcacgagatctcctggcactacgaccaggaccacccctacaagacctgggcctaccacggcagctacgagaccaagcagaccgggtccgccagctccatggtcaacggcgtggtgcgcctgctgacgaagccctgggacgtcgtgcccatggtgacccagatggcgatgaccgacaccacgccgttcgggcagcagcgcgtcttcaaggagaaggtggacacccggacccaggagcccaaggagggcaccaagaagctcatgaagatcacggccgagtggctgtggaaggagctgggcaagaagaagacgccccggatgtgcacccgggaggagttcaccaagaaggtgcgcagcaacgccgccctcggggccatcttcacggacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggggagttcggcaaggccaagggcagccgcgccatctggtacatgtggctgggggcgcggttcctcgagttcgaggccctgggcttcctgaacgaggaccactggttcagccgcgggaactccctcagcggcgtcgagggggagggcctgcaccggctgggctacatcctccgcgacgtggggaagaaggagggcggggccatgtacgccgacgacaccgccggctgggacacccggatcacgctggaggacctgaagaacgaggagatggtcaccaaccacatgaagggggagcacaagaagctcgcggaggccatcttcaagctgacctaccagaacaaggtggtgcgcgtccagcggcccaccccgcgcggcacggtgatggacatcatctcccggcgcgaccagcggggcagcgggcaggtcggcacctacgggctgaacaccttcaccaacatggaggcccagctcatccgccagatggagggcgagggcatcttcaagtccatccagcacctgacggccaccgaggagatcgccgtccagaactggctggcgcgcgtggggcgggagcgcctcagccggatggccatctccggcgacgactgcgtggtcaagcccatcgacgaccgcttcgccagcgccctgaccgccctgaacgacatggggaaggtgcggaaggacatccagcagtgggagccctcccgcggctggaacgactggacccaggtgcccttctgcagccaccacttccacgagctcgtcatgaaggacgggcgggtgctggtggtcccgtgccgcaaccaggacgagctgatcggccgggcgcgcatctcccagggcgccgggtggagcctcaaggagacggcctgcctgggcaagtcctacgcccagatgtggaccctgatgtacttccaccggcgcgacctccggctggccgcgaacgccatctgcagcgccgtgccctcccactgggtgcccaccagccgcaccacctggtccatccacgccaagcacgagtggatgacgaccgaggacatgctggcggtctggaaccgggtgtggatccaggagaacccctggatggaggacaagaccccggtggagagctgggaggaggtcccctacctcgggaagcgcgaggaccagtggtgcggcagcctgatcgggctgacctcccgggccacgtgggccaagaacatccagaccgccatcaaccaggtgcgcagcctcatcggcaacgaggagtacaccgactacatgccctccatgaagcggttccgccgcgaggaggaggaggccggcgtgctgtggtga

SEQ ID NO: 9208 - RNA, 9876 nt, synthetic construct
  misc_feature 1..9876: note = derived and/or modified CDS sequence (opt1) from DENV-2__EU569699__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgaagttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggacaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcctgctggaggagatgctccgcacccggatcggcacgaagcacgcgatcctgctggtggccgtgagcttcgtcaccctcatcaccgggaacatgtccttccgcgacctgggccgcgtgatggtgatggtcggggccaccatgacggacgacatcggcatgggcgtgacctacctggccctcctggccgcgttcaaggtgcggcccaccttcgccgccgggctgctcctgcgcaagctgaccagcaaggagctcatgatggccacgatcggcatcgccctgctgtcccagagcaccatccccgagaccatcctcgagctgaccgacgcgctggccctcgggatgatggtcctgaagatcgtgcggaacatggagaagtaccagctggccgtgacggtcatggccatctcctgcgtgccgaacgccgtgatcctccagaacgcgtggaaggtcagctgcaccatcctggccgccgtgtccgtcagccccctgctcctgacctccagccagcagaaggccgactggatccccctggcgctcaccatcaagggcctgaaccccacggccatcttcctgaccaccctctcccgcaccagcaagaagcggtcctggccgctgaacgaggccatcatggccgtgggcatggtgagcatcctggcctccagcctcctgaagaacgacatccccatgacggggcccctggtcgcgggcgggctcctgaccgtgtgctacgtgctgaccggccgcagcgccgacctcgagctggagcgggccgccgacgtcaagtgggaggaccaggccgagatctccgggagctcccccatcctgagcatcaccatctccgaggacggcagcatgtccatcaagaacgaggaggaggagcagacgctcaccatcctgatccgcaccggcctgctcgtgatcagcggggtgttcccggtctccatccccatcaccgcggccgcctggtacctgtgggaggtgaagaagcagcgggccggcgtgctgtgggacgtccccagcccgccgcccgtggagaaggccgagctcgaggacggggcgtaccgcatcaagcagcggggcatcctggggtactcccagatcggcgccggcgtgtacaaggaggggaccttccacacgatgtggcacgtcacccgcggcgccgtgctgatgcaccgggggaagcgcatcgagcccagctgggccgacgtgaagaaggacctcatctcctacggcgggggctggaagctggagggcgagtggaaggagggggaggaggtccaggtgctggccctcgagcccggcaagaacccccgggcggtgcagaccaagcccgggatcttcaagaccaacacgggcaccatcggggccgtcagcctggacttctcccccggcaccagcggctcccccatcgtggaccgcaaggggaaggtggtcggcctgtacgggaacggcgtggtgacccggagcggcgcctacgtctccgccatcgcgcagacggagaagtccatcgaggacaaccccgagatcgaggacgacatcttccgcaagaagcggctcaccatcatggacctgcaccccggggccggcaagaccaagcgctacctgcccgccatcgtgcgggaggccatcaagcgcgggctgcgcaccctcatcctggccccgacgcgggtggtcgcggccgagatggaggaggccctgcgcggcctccccatccggtaccagaccaccgccatcaagaccgagcacacggggcgcgagatcgtggacctgatgtgccacgccaccttcaccatgcggctgctcagccccgtgcgcgtccccaactacaacctgatcatcatggacgaggcgcacttcaccgacccggcctccatcgccgcccggggctacatcagcacgcgcgtggagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtctggttcgtgccctccatcaaggccgggaacgacatcgcggcctgcctgcgcaagaacggcaagaaggtgatccagctcagccggaagaccttcgactccgagtacgtcaagacccgcgccaacgactgggacttcgtggtgaccacggacatcagcgagatgggcgccaacttcaaggccgagcgggtcatcgacccgcgccggtgcatgaagcccgtgatcctgaccgacggggaggagcgcgtgatcctggcgggccccatgcccgtcacccactccagcgccgcccagcggcgcgggcgcatcggccggaacccgaagaacgagaacgaccagtacatctacatgggggagcccctcgagaacgacgaggactgcgcccactggaaggaggccaagatgctgctggacaacatcaacacccccgagggcatcatcccctccatgttcgagccggagcgcgagaaggtggacgcgatcgacggcgagtaccggctccgcggggaggcccggaagacgttcgtggacctgatgcgccggggcgacctgcccgtctggctcgcctacaaggtggccgccgaggggatcaactacgcggaccgcaagtggtgcttcgacggcatcaagaacaaccagatcctggaggagaacatggaggtggagatctggaccaaggagggggagcggaagaagctgaagccccgctggctcgacgcccggatctacagcgacccgctggccctgaaggagttcaaggagttcgccgcgggccgcaagtccctcaccctgaacctgatcaccgagatgggccggctccccacgttcatgacccagaaggcccgcaacgccctggacaacctggccgtcctccacaccgccgaggccgggggccgggcctacaaccacgccctgagcgagctgcccgagaccctcgagacgctgctgctcctgaccctgctcgccaccgtgaccgggggcatcttcctgttcctgatgtccggcaaggggatcggcaagatgaccctcgggatgtgctgcatcatcacggccagcatcctgctgtggtacgcgcagatccagccccactggatcgccgcctccatcatcctcgagttcttcctgatcgtcctgctcatcccggagcccgagaagcagcgcacgccccaggacaaccagctgacctacgtggtgatcgccatcctgaccgtcgtggccgcgacgatggccaacgagatgggcttcctcgagaagaccaagaaggacctggggctgggcagcatcaccacccaggagagcgagtccaacatcctcgacatcgacctgcggcccgccagcgcctggacgctgtacgccgtggcgaccaccttcgtcaccccgatgctccgccactccatcgagaacagctccgtgaacgtgagcctgacggccatcgccaaccaggccaccgtcctgatgggcctcgggaagggctggcccctgtccaagatggacatcggggtgcccctgctcgcgatcggctgctacagccaggtgaaccccatcaccctgaccgccgccctgctcctgctggtcgcccactacgccatcatcgggccgggcctccaggcgaaggccacgcgggaggcccagaagcgcgccgccgcgggcatcatgaagaaccccaccgtggacgggatcaccgtgatcgacctggagcccatcccctacgacccgaagttcgagaagcagctgggccaggtcatgctcctgatcctgtgcgtgacccaggtgctcatgatgcggacgacctgggccctgtgcgaggccctgaccctcgccaccgggcccatctccacgctgtgggagggcaaccccgggcgcttctggaacaccaccatcgccgtcagcatggcgaacatcttccgcggctcctacctggccggcgccgggctcctgttcagcatcatgaagaacaccacgaacacccggcgcggcaccgggaacatcggcgagaccctgggcgagaagtggaagtcccggctcaacgccctgggcaagagcgagttccagatctacaagaagtccggcatccaggaggtggaccgcacgctggcgaaggaggggatcaagcggggcgagaccgaccaccacgccgtgagccgcgggtccgccaagctccggtggttcgtcgagcgcaacatggtgacccccgagggcaaggtggtcgacctgggctgcgggcggggcgggtggagctactactgcggcgggctgaagaacgtgcgcgaggtgaagggcctcaccaagggcgggccgggccacgaggagcccatccccatgtccacgtacgggtggaacctggtccggctgcagagcggcgtggacgtgttcttcacgccgcccgagaagtgcgacaccctcctgtgcgacatcggggagagctcccccaaccccaccatcgaggccggccgcaccctgcgggtcctcaacctggtggagaactggctgaacaacaacacgcagttctgcatcaaggtgctcaacccctacatgcccagcgtcatcgagaagatggaggccctgcagcgcaagtacggcggggcgctggtgcggaaccccctgtcccgcaacagcacccacgagatgtactgggtgtccaacgccaccggcaacatcgtcagctccgtgaacatgatcagccggatgctcatcaaccgcttcaccatgaagcacaagaaggccacgtacgagcccgacgtggacctggggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtcaacggcgtggtgcgcctcctgaccaagccctgggacgtcgtgcccatggtgacccagatggcgatgacggacaccaccccgttcgggcagcagcgggtcttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcacccggaaggtgcgcagcaacgccgccctgggggccatcttcaccgacgagaacaagtggaagtccgcgcgggaggccgtcgaggacggccgcttctgggagctcgtggaccgggagcgcaacctgcacctggaggggaagtgcgagacctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgggaacagcctgagcggcgtcgagggggagggcctccaccggctgggctacatcctgcgcgacgtggggaagaaggagggcggggccatgtacgccgacgacacggccggctgggacacccggatcaccctcgaggacctgaagaacgaggagatggtcaccaaccacatgaagggggagcacaagaagctggcggaggccatcttcaagctcacgtaccagaacaaggtggtgcgcgtccagcggcccaccccgcgcggcaccgtgatggacatcatctcccggcgcgaccagcgcggcagcgggcaggtcggcacctacgggctgaacacgttcaccaacatggaggcccagctgatccggcagatggagggcgagggcatcttcaagtccatccagcacctcaccgccatcgaggagatcgccgtccagaactggctggcgcgcgtggggcgggagcgcctgagccggatggccatctccggcgacgactgcgtgatcaagcccatcgacgaccgcttcgccagcgccctcaccgccctgaacgacatggggaaggtccggaaggacatccagcagtgggagccctcccgcggctggaacgactggacccaggtgcccttctgcagccaccacttccacgagctggtgatgaaggacgggcgggtcctcgtggtgccgtgccgcaaccaggacgagctgatcggccgggcgcgcatctcccagggcgccgggtggagcctgaaggagaccgcctgcctcggcaagtcctacgcccagatgtggaccctgatgtacttccaccggcgcgacctgcggctcgccgcgaacgccatctgcagcgccgtcccctcccactgggtgcccaccagccgcaccacgtggtccatccacgccaagcacgagtggatgaccaccgaggacatgctggcggtgtggaaccgggtctggatccaggagaacccctggatggaggacaagaccccggtggagagctgggaggaggtgccctacctggggaagcgcgaggaccagtggtgcggctccctcatcgggctgacgagccgggccacctgggccaagaacatccagaccgccatcaaccaggtccgcagcctgatcggcaacgaggagtacaccgactacatgccctccatgaagcgcttccggcgcgaggaggaggaggccggcgtgctctggtga

SEQ ID NO: 9209 - RNA, 9876 nt, synthetic construct
  misc_feature 1..9876: note = derived and/or modified CDS sequence (opt1) from DENV-2__KF955366__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacctcccccggcagccgcgaccccttcccgcagtccaacgcccccatcatggacgaggagcgggagatccccgagcgcagctggaactccgggcacgagtgggtgaccgacttcaagggcaagaccgtctggttcgtgcccagcatcaaggccgggaacgacatcgcggcctgcctccggaagaacggcaagaaggtgatccagctgtcccgcaagacgttcgacagcgagtacgtcaagacccgggccaacgactgggacttcgtggtgaccaccgacatctccgagatgggcgccaacttcaaggccgagcgcgtcatcgacccgcggcgctgcatgaagcccgtgatcctgacggacggggaggagcgggtgatcctcgcgggccccatgcccgtcacccacagctccgccgcccagcgccgggggcgcatcggccgcaacccgaagaacgagaacgaccagtacatctacatgggggagcccctggagaacgacgaggactgcgcccactggaaggaggccaagatgctgctcgacaacatcaacacccccgagggcatcatccccagcatgttcgagccggagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccccggtggctggacgcccgcatctactccgacccgctggccctcaaggagttcaaggagttcgccgcgggccgcaagagcctgaccctgaacctcatcaccgagatgggccgcctgcccaccttcatgacgcagaaggcccggaacgccctggacaacctcgccgtcctgcacaccgccgaggccgggggccgcgcctacaaccacgccctgtccgagctccccgagaccctggagaccctgctcctgctgacgctcctggccaccgtgaccgggggcatcttcctgttcctcatgagcggcaaggggatcggcaagatgaccctggggatgtgctgcatcatcaccgcctccatcctgctctggtacgcgcagatccagccccactggatcgccgccagcatcatcctggagttcttcctgatcgtcctcctgatcccggagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagtccgagagcaacatcctggacatcgacctgcgccccgcctccgcctggaccctctacgccgtggcgacgaccttcgtcaccccgatgctgcggcacagcatcgagaactccagcgtgaacgtgtccctgaccgccatcgccaaccaggccacggtcctcatgggcctggggaagggctggcccctgagcaagatggacatcggggtgcccctcctggcgatcggctgctactcccaggtgaaccccatcaccctgaccgccgccctcctgctgctcgtcgcccactacgccatcatcgggccgggcctgcaggcgaaggccacccgcgaggcccagaagcgggccgccgcgggcatcatgaagaaccccacggtggacgggatcaccgtgatcgacctggagcccatcccctacgacccgaagttcgagaagcagctcggccaggtcatgctgctgatcctctgcgtgacccaggtgctgatgatgcgcaccacgtgggccctgtgcgaggccctcaccctggccaccgggcccatcagcaccctgtgggagggcaaccccgggcggttctggaacacgaccatcgccgtctccatggcgaacatcttccgcggcagctacctcgccggcgccgggctgctgttctccatcatgaagaacaccaccagcacgcgccggggcaccgggaacatcggcgagaccctcggcgagaagtggaagtcccgcctgaacgccctgggcaagagcgagttccagatctacaagaagtccggcatccaggaggtggaccggaccctcgcgaaggaggggatcaagcgcggcgagacggaccaccacgccgtgagccgggggtccgccaagctgcgctggttcgtcgagcggaacatggtgacccccgagggcaaggtggtcgacctgggctgcgggcgcggcgggtggagctactactgcggcgggctcaagaacgtgcgggaggtgaagggcctgaccaagggcgggccgggccacgaggagcccatccccatgagcacctacgggtggaacctggtccgcctccagtccggcgtggacgtgttcttcacgcccccggagaagtgcgacaccctgctgtgcgacatcggggagagctcccccaaccccaccatcgaggccggccggaccctccgcgtcctgaacctggtggagaactggctcaacaacaacacccagttctgcatcaaggtgctgaacccctacatgccgagcgtcatcgagaagatggaggccctgcagcggcagtacggcggggcgctcgtgcgcaaccccctgtcccggaacagcacgcacgagatgtactgggtgtccaacgccaccggcaacatcgtcagctccgtgaacatgatcagccgcatgctgatcaaccggttcaccatgaagcacaagaaggccacctacgagcccgacgtggacctggggtccggcacgcgcaacatcgggatcgagagcgagatcccgaacctcgacatcatcggcaagcggatcgagaagatcaagcaggagcacgagatctcctggcactacgaccaggaccacccctacaagacctgggcctaccacggcagctacgagaccaagcagaccgggtccgccagctccatggtcaacggcgtggtgcgcctgctgacgaagccctgggacgtcgtgcccatggtgacccagatggcgatgaccgacaccacgccgttcgggcagcagcgcgtcttcaaggagaaggtggacacccggacccaggagcccaaggagggcaccaagaagctcatgaagatcacggccgagtggctgtggaaggagctgggcaagaagaagacgccccggatgtgcacccgggaggagttcaccaagaaggtgcgcagcaacgccgccctcggggccatcttcacggacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggggagttcggcaaggccaagggcagccgcgccatctggtacatgtggctgggggcgcggttcctcgagttcgaggccctgggcttcctgaacgaggaccactggttcagccgcgggaactccctcagcggcgtcgagggggagggcctgcaccggctgggctacatcctccgcgacgtggggaagaaggagggcggggccatgtacgccgacgacaccgccggctgggacacccggatcacgctggaggacctgaagaacgaggagatggtcaccaaccacatgaagggggagcacaagaagctcgcggaggccatcttcaagctgacctaccagaacaaggtggtgcgcgtccagcggcccaccccgcgcggcacggtgatggacatcatctcccggcgcgaccagcggggcagcgggcaggtcggcacctacgggctgaacaccttcaccaacatggaggcccagctcatccgccagatggagggcgagggcatcttcaagtccatccagcacctgacggccaccgaggagatcgccgtccagaactggctggcgcgcgtggggcgggagcgcctcagccggatggccatctccggcgacgactgcgtggtcaagcccatcgacgaccgcttcgccagcgccctgaccgccctgaacgacatggggaaggtgcggaaggacatccagcagtgggagccctcccgcggctggaacgactggacccaggtgcccttctgcagccaccacttccacgagctcgtcatgaaggacgggcgggtgctggtggtcccgtgccgcaaccaggacgagctgatcggccgggcgcgcatctcccagggcgccgggtggagcctcaaggagacggcctgcctgggcaagtcctacgcccagatgtggaccctgatgtacttccaccggcgcgacctccggctggccgcgaacgccatctgcagcgccgtgccctcccactgggtgcccaccagccgcaccacctggtccatccacgccaagcacgagtggatgacgaccgaggacatgctggcggtctggaaccgggtgtggatccaggagaacccctggatggaggacaagaccccggtggagagctgggaggaggtcccctacctcgggaagcgcgaggaccagtggtgcggcagcctgatcgggctgacctcccgggccacgtgggccaagaacatccagaccgccatcaaccaggtgcgcagcctcatcggcaacgaggagtacaccgactacatgccctccatgaagcggttccgccgcgaggaggaggaggccggcgtgctgtggtga

SEQ ID NO: 9210 - RNA, 9876 nt, synthetic construct
  misc_feature 1..9876: note = derived and/or modified CDS sequence (opt1) from DENV-2__EU569700__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatgggcctggggaagggctggcccctgtccaagatggacatcggggtgcccctcctggcgatcggctgctacagccaggtgaacccgatcaccctgaccgccgccctcctgctgctcgtcgcccactacgccatcatcgggcccggcctgcaggcgaaggccacccgcgaggcccagaagcgggccgccgcgggcatcatgaagaaccccacggtggacgggatcaccgtgatcgacctggagcccatcccgtacgaccccaagttcgagaagcagctcggccaggtcatgctgctgatcctctgcgtgacccaggtgctgatgatgcgcaccacgtgggccctgtgcgaggccctcaccctggccaccgggcccatctccaccctgtgggagggcaaccccgggcggttctggaacacgaccatcgccgtcagcatggcgaacatcttccgcggctcctacctcgccggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagacggaccaccacgccgtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacctacgggtggaacctggtccgcctccagagcggcgtggacgtgttcttcacgccgcccgagaagtgcgacaccctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacgcacgagatgtactgggtgagcaacgccaccggcaacatcgtctccagcgtgaacatgatctcccgcatgctgatcaaccggttcaccatgaagcacaagaaggccacctacgagccggacgtggacctggggagcggcacgcgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagaccgggagcgcctccagcatggtcaacggcgtggtgcgcctgctgacgaagccctgggacgtcgtgccgatggtgacccagatggcgatgaccgacaccacgcccttcgggcagcagcgcgtcttcaaggagaaggtggacacccggacccaggagcccaaggagggcaccaagaagctcatgaagatcacggccgagtggctgtggaaggagctgggcaagaagaagacgccccgcatgtgcacccgggaggagttcaccaagaaggtgcgctccaacgccgccctcggggccatcttcacggacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacccggatcacgctggaggacctgaagaacgaggagatggtcaccaaccacatgaagggggagcacaagaagctcgcggaggccatcttcaagctgacctaccagaacaaggtggtgcgcgtccagcggccgacgccccgcggcacggtgatggacatcatcagccggcgcgaccagcggggctccgggcaggtcggcacctacgggctgaacaccttcaccaacatggaggcccagctcatccgccagatggagggcgagggcatcttcaagagcatccagcacctgacggccaccgaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagacggcctgcctgggcaagagctacgcccagatgtggaccctgatgtacttccaccggcgcgacctccggctggccgcgaacgccatctgctccgccgtgcccagccactgggtgcccacctcccgcaccacctggagcatccacgccaagcacgagtggatgacgaccgaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacgtgggccaagaacatccagaccgccatcaaccaggtgcgctccctcatcggcaacgaggagtacaccgactacatgcccagcatgaagcggttccgccgcgaggaggaggaggccggcgtgctgtggtga

SEQ ID NO: 9211 - RNA, 9876 nt, synthetic construct
  misc_feature 1..9876: note = derived and/or modified CDS sequence (opt1) from DENV-2__KF955369__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccaccgtggcccccagcatgaccatgcgctgcatcggcatcagcaaccgggacttcgtcgagggcgtgagcgggggcagctgggtggacatcgtcctcgagcacgggagctgcgtgacgaccatggcgaagaacaagcccaccctggacttcgagctgatcaagaccgaggccaagcagcccgccacgctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcgggctgttcggcaagggcggcatcgtgacctgcgccatgttcacgtgcaagaagaacatggagggcaaggtggtgcagcccgagaacctggagtacacgatcgtcatcacgccccacagcggggaggagcacgcggtgggcaacgacaccgggaagcacggcaaggagatcaagatcaccccgcagtccagcatcaccgaggccgagctgacggggtacggcaccgtgaccatggagtgcagcccccggaccggcctcgacttcaacgagatggtcctgctgcagatggaggacaaggcctggctcgtgcaccggcagtggttcctggacctgcccctcccctggctgccgggggccgacacgcagggcagcaactggatccagaaggagaccctggtgaccttcaagaacccccacgccaagaagcaggacgtcgtggtcctcgggtcccaggagggcgcgatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacgcagcacgggaccatcgtgatccgcgtccagtacgagggcgacggctccccctgcaagatccccttcgagatcaccgacctggagaagcggcacgtgctcgggcgcctgatcaccgtgaacccgatcgtcacggagaaggacagccccgtgaacatcgaggccgagccgcccttcggcgactcctacatcatcatcggggtggagccgggccagctgaagctcaactggttcaagaaggggagctccatcggccagatgttcgagaccaccatgcgcggcgcgaagcggatggccatcctgggggacaccgcctgggacttcggcagcctcgggggcgtcttcacgtccatcgggaaggccctccaccaggtgttcggcgccatctacggcgcggccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccgtcgtgcaggccgactccggctgcgtggtcagctggaagaacaaggagctcaagtgcggctccgggatcttcatcaccgacaacgtgcacacctggaccgagcagtacaagttccagcccgagagccccagcaagctggcgtccgccatccagaaggcccacgaggagggcatctgcgggatccggagcgtgacgcgcctggagaacctcatgtggaagcagatcacccccgagctgaaccacatcctgtccgagaacgaggtcaagctcaccatcatgaccggcgacatcaaggggatcatgcaggccggcaagcggagcctgcgcccgcagcccacggagctgaagtactcctggaagacctggggcaaggccaagatgctcagcaccgagtcccacaaccagaccttcctgatcgacgggcccgagacggcggagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggccgtgcacgcggacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgccgggccctggcacctcggcaagctggagatggacttcgacttctgcgaggggaccacggtggtcgtgaccgaggactgcggcaaccggggccccagcctgcgcaccaccacggcgagcgggaagctcatcaccgagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacgcgcatcggcaccaagcacgccatcctgctcgtggcggtcagcttcgtgaccctgatcaccgggaacatgtccttccgggacctgggccgcgtgatggtcatggtgggggccacgatgaccgacgacatcggcatgggcgtgacctacctcgccctgctggccgccttcaaggtccgccccaccttcgcggccgggctcctgctgcggaagctcacgagcaaggagctgatgatggccaccatcggcatcgccctgctctcccagagcaccatccccgagaccatcctggagctgacggacgccctcgcgctggggatgatggtgctgaagatcgtgcgcaacatggagaagtaccagctcgccgtcaccatcatggccatctcctgcgtgccgaacgccgtgatcctgcagaacgcctggaaggtcagctgcaccatcctggcggccgtgtccgtcagccccctcctgctgacctccagccagcagaaggccgactggatccccctcgccctgacgatcaagggcctgaaccccaccgcgatcttcctcaccaccctgtcccggacgagcaagaagcgctcctggccgctgaacgaggccatcatggccgtgggcatggtgagcatcctcgcctccagcctgctgaagaacgacatccccatgaccgggcccctcgtcgccggcgggctgctgaccgtgtgctacgtgctcaccggccggagcgcggacctggagctggagcgcgccgccgacgtcaagtgggaggaccaggccgagatctccgggagctcccccatcctcagcatcacgatctccgaggacggcagcatgtccatcaagaacgaggaggaggagcagaccctgaccatcctgatccggaccggcctcctggtgatcagcggggtgttcccggtctccatccccatcaccgccgcggcctggtacctgtgggaggtgaagaagcagcgcgccggcgtgctctgggacgtccccagcccgccgcccgtggagaaggccgagctggaggacggggcctaccggatcaagcagcgcggcatcctggggtactcccagatcggcgcgggcgtgtacaaggaggggacgttccacaccatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgccgtgcagaccaagcccgggatcttcaagacgaacaccggcaccatcggggcggtcagcctggacttctcccccggcaccagcggctcccccatcgtggaccggaaggggaaggtggtcggcctctacgggaacggcgtggtgacgcgcagcggcgcctacgtctccgccatcgcccagaccgagaagtccatcgaggacaaccccgagatcgaggacgacatcttccggaagaagcgcctgaccatcatggacctgcaccccggggcgggcaagaccaagcggtacctccccgccatcgtgcgcgaggccatcaagcgggggctgcgcacgctgatcctggccccgacccgcgtggtcgccgcggagatggaggaggccctccggggcctgcccatccgctaccagacccccgccatcaagaccgagcacacggggcgggagatcgtggacctgatgtgccacgccaccttcaccatgcgcctcctgagccccgtgcgggtcccgaactacaacctgatcatcatggacgaggcccacttcaccgaccccgcgtccatcgccgcccgcggctacatcagcacgcgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgaccgacttcaagggcaagacggtctggttcgtgccgtccatcaaggccgggaacgacatcgccgcgtgcctccggaagaacggcaagaaggtgatccagctgagccgcaagaccttcgactccgagtacgtcaagacccgggccaacgactgggacttcgtggtgaccacggacatcagcgagatgggcgccaacttcaaggccgagcgcgtcatcgacccccggcgctgcatgaagcccgtgatcctgaccgacggggaggagcgggtgatcctcgccggccccatgccggtcacccactccagcgcggcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcgcgcaagacgttcgtggacctgatgcggcgcggcgacctccccgtctggctggcctacaaggtggccgccgaggggatcaactacgccgaccggaagtggtgcttcgacggcatcaagaacaaccagatcctggaggagaacatggaggtggagatctggaccaaggagggggagcgcaagaagctcaagccgcggtggctggacgcgcgcatctacagcgaccccctggccctcaaggagttcaaggagttcgccgccggccggaagtccctgaccctgaacctcatcaccgagatgggccgcctgcccacgttcatgacccagaaggcgcggaacgccctggacaacctcgccgtcctgcacaccgccgaggccgggggccgcgcgtacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggccagcatcctgctctggtacgcccagatccagccgcactggatcgcggcctccatcatcctggagttcttcctgatcgtcctcctgatccccgagcccgagaagcagcggacgccccaggacaaccagctgacctacgtggtgatcgccatcctcaccgtcgtggccgccacgatggcgaacgagatgggcttcctggagaagaccaagaaggacctggggctcggcagcatcaccacccaggagagcgagtccaacatcctggacatcgacctgcgcccggccagcgcctggacgctctacgccgtggccaccaccttcgtcacccccatgctgcggcactccatcgagaacagctccgtgaacgtgagcctgacggcgatcgccaaccaggccaccgtcctcatgggcctggggaagggctggcccctgtccaagatggacatcggggtgcccctcctggccatcggctgctacagccaggtgaacccgatcaccctgaccgcggccctcctgctgctcgtcgcccactacgccatcatcgggcccggcctgcaggccaaggcgacgcgcgaggcccagaagcgggccgccgccggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcgcacgacctgggcgctgtgcgaggccctcaccctggccaccgggcccatctccacgctgtgggagggcaaccccgggcggttctggaacaccaccatcgccgtcagcatggccaacatcttccgcggctcctacctcgcgggcgccgggctgctgttcagcatcatgaagaacaccacgtccacccgccggggcaccgggaacatcggcgagaccctcggcgagaagtggaagtcccgcctgaacgccctggggaagtccgagttccagatctacaagaagtccggcatccaggaggtggaccggacgctcgccaaggaggggatcaagcgcggcgagaccgaccaccacgcggtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacgtacgggtggaacctggtccgcctccagagcggcgtggacgtgttcttcaccccgcccgagaagtgcgacaccctgctgtgcgacatcggggagtccagccccaaccccaccatcgaggccggccggaccctccgcgtcctgaacctggtggagaactggctcaacaacaacacgcagttctgcatcaaggtgctgaacccgtacatgccctccgtcatcgagaagatggaggccctgcagcggcagtacggcggggccctcgtgcgcaaccccctgagccggaactccacccacgagatgtactgggtgagcaacgcgaccggcaacatcgtctccagcgtgaacatgatctcccgcatgctgatcaaccggttcaccatgaagcacaagaaggccacgtacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagacggggagcgcctccagcatggtcaacggcgtggtgcgcctgctgaccaagccctgggacgtcgtgccgatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagacgccccgcatgtgcacccgggaggagttcacgaagaaggtgcgctccaacgccgccctcggggccatcttcaccgacgagaacaagtggaagtccgcccgggaggcggtcgaggacggccgcttctgggagctggtggaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcccggttcctcgagttcgaggcgctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacgcggatcaccctggaggacctgaagaacgaggagatggtcaccaaccacatgaagggggagcacaagaagctcgccgaggcgatcttcaagctgacctaccagaacaaggtggtgcgcgtccagcggccgacgccccgcggcaccgtgatggacatcatcagccggcgcgaccagcggggctccgggcaggtcggcacctacgggctgaacaccttcacgaacatggaggcccagctcatccgccagatggagggcgagggcatcttcaagagcatccagcacctgaccgccaccgaggagatcgccgtccagaactggctggcccgcgtggggcgggagcgcctctcccggatggcgatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcccgcatcagccagggcgcggggtggtccctcaaggagaccgcctgcctgggcaagagctacgcccagatgtggaccctgatgtacttccaccggcgcgacctccggctggccgccaacgcgatctgctccgccgtgcccagccactgggtgcccacctcccgcaccacgtggagcatccacgccaagcacgagtggatgaccaccgaggacatgctggccgtctggaaccgggtgtggatccaggagaacccgtggatggaggacaagacccccgtggagtcctgggaggaggtcccctacctcgggaagcgcgaggaccagtggtgcggcagcctgatcgggctgacgagccgggcgacctgggccaagaacatccagaccgccatcaaccaggtgcgctccctcatcggcaacgaggagtacaccgactacatgcccagcatgaagcggttccgccgcgaggaggaggaggccggcgtgctgtggtga

SEQ ID NO: 9212 - RNA, 9876 nt, synthetic construct
  misc_feature 1..9876: note = derived and/or modified CDS sequence (opt1) from DENV-2__EU569702__SS-prME
  source 1..9876: mol_type = other RNA
accgccggcgtcatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagcgcgccagcttcatcgaggtgaagtcctgccactggcccaagagccacaccctgtggtccaacggcgtcctggagagcgagatgatcatccccaagaacttcgccgggcccgtgtcccagcacaactaccggccgggctaccacacgcagaccgcggggccctggcacctcggcaagctggagatggacttcgacttctgcgaggggaccaccgtggtcgtgacggaggactgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtgaacagcctggtcaccgccgggcacggccagatcgacaacttctccctcggcgtgctggggatggccctgttcctcgaggagatgctgcgcacccggatcggcacgaagcacgcgatcctgctcgtggccgtcagcttcgtgaccctgatcaccgggaacatgtccttccgcgacctgggccgcgtgatggtcatggtgggggccaccatgacggacgacatcggcatgggcgtgacctacctcgccctgctggccgcgttcaaggtccggcccaccttcgccgccgggctcctgctgcgcaagctcaccagcaaggagctgatgatggccacgatcggcatcgccctgctctcccagagcaccatccccgagaccatcctggagctgaccgacgcgctcgccctggggatgatggtgctgaagatcgtgcggaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccgcaccagcaagaagcggtcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccgcagcgccgacctggagctggagcgggccgccgacgtcaagtgggaggaccaggccgagatctccgggagctcccccatcctcagcatcaccatctccgaggacggcagcatgtccatcaagaacgaggaggaggagcagacgctgaccatcctgatccgcaccggcctcctggtgatcagcggggtgttcccggtctccatccccatcaccgcggccgcctggtacctgtgggaggtgaagaagcagcgggccggcgtgctctgggacgtccccagcccgccgcccgtggagaaggccgagctggaggacggggcgtaccgcatcaagcagcggggcatcctggggtactcccagatcggcgccggcgtgtacaaggaggggaccttccacacgatgtggcacgtcacccgcggcgccgtgctcatgcaccgggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagaccaagcccgggatcttcaagaccaacacgggcaccatcggggccgtcagcctggacttctcccccggcaccagcggctcccccatcgtggaccgcaaggggaaggtggtcggcctctacgggaacggcgtggtgacccggagcggcgcctacgtctccgccatcgcgcagacggagaagtccatcgaggacaaccccgagatcgaggacgacatcttccgcaagaagcggctgaccatcatggacctgcaccccggggccggcaagaccaagcgctacctccccgccatcgtgcgggaggccatcaagcgcgggctgcgcaccctgatcctggccccgacgcgggtggtcgcggccgagatggaggaggccctccgcggcctgcccatccggtaccagacccccgccatcaagaccgagcacaccgggcgcgagatcgtggacctgatgtgccacgccacgttcaccatgcggctcctgagccccgtgcgcgtcccgaactacaacctgatcatcatggacgaggcgcacttcaccgaccccgcctccatcgccgcccggggctacatcagcacccgcgtggagatgggcgaggccgcggggatcttcatgacggccacgccgcccggctcccgggacccgttcccccagagcaacgcccccatcatggacgaggagcgcgagatccccgagcggtcctggaacagcgggcacgagtgggtgaccgacttcaagggcaagaccgtctggttcgtgccgtccatcaaggccgggaacgacatcgcggcctgcctccgcaagaacggcaagaaggtgatccagctgagccggaagacgttcgactccgagtacgtcaagacccgcgccaacgactgggacttcgtggtgaccaccgacatcagcgagatgggcgccaacttcaaggccgagcgggtcatcgacccccgccggtgcatgaagcccgtgatcctgacggactccgaggagcgcgtgatcctcgcggggcccatgccggtcacccacagctccgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgaggggatcatcccgagcatgttcgagcccgagcgcgagaaggtggacgcgatcgacggcgagtaccggctgcgcggcgaggcccggaagaccttcgtggacctgatgcgccgcggggacctccccgtctggctggcctacaaggtggccgccgagggcatcaactacgcggaccgcaagtggtgcttcgacgggatcaagaacaaccagatcctggaggagaacatggaggtggagatctggacgaaggagggcgagcggaagaagctcaagccgcgctggctggacgcccggatctactccgaccccctggccctcaaggagttcaaggagttcgccgcggggcgcaagagcctgaccctgaacctcatcaccgagatgggccggctgcccaccttcatgacgcagaaggcccgcaacgccctggacaacctcgccgtcctgcacaccgccgaggcgggcgggcgggcctacaaccacgccctgtccgagctccccgagaccctggagaccctgctcctgctgacgctcctggccaccgtgaccggcgggatcttcctgttcctcatgagcggcaagggcatcgggaagatgaccctgggcatgtgctgcatcatcaccgcctccatcctgctctggtacgcgcagatccagccgcactggatcgccgccagcatcatcctggagttcttcctgatcgtcctcctgatccccgagcccgagaagcagcgcacgccccaggacaaccagctgacctacgtggtgatcgccatcctcaccgtcgtggccgcgaccatggccaacgagatggggttcctggagaagacgaagaaggacctgggcctcgggagcatcaccacccaggagtccgagagcaacatcctggacatcgacctgcggccggcctccgcctggaccctctacgccgtggcgacgaccttcgtcacccccatgctgcgccacagcatcgagaactccagcgtgaacgtgtccctgaccgccatcgccaaccaggccacggtcctcatgggcctgggcaaggggtggcccctgagcaagatggacatcggcgtgcccctcctggcgatcgggtgctactcccaggtgaacccgatcaccctgaccgccgccctcctgctgctcgtcgcccactacgccatcatcggccccgggctgcaggcgaaggccacccgggaggcccagaagcgcgccgccgcgggcatcatgaagaaccccacggtggacggcatcaccgtgatcgacctggagcccatcccgtacgaccccaagttcgagaagcagctcgggcaggtcatgctgctgatcctctgcgtgacccaggtgctgatgatgcggaccacgtgggccctgtgcgaggccctcaccctggccaccggccccatcagcaccctgtgggaggggaaccccggccgcttctggaacacgaccatcgccgtctccatggcgaacatcttccgcgggagctacctcgccggcgccggcctgctgttctccatcatgaagaacaccaccagcacgcggcgcgggaccggcaacatcggggagaccctcggcgagaagtggaagtcccggctgaacgccctgggcaagagcgagttccagatctacaagaagtccgggatccaggaggtggaccgcaccctcgcgaaggagggcatcaagcgcggggagacggaccaccacgccgtgagccgcggctccgccaagctgcggtggttcgtcgagcgcaacatggtgaccccggaggggaaggtggtcgacctgggctgcggccgcgggggctggagctactactgcgggggcctcaagaacgtgcgcgaggtgaaggggctgaccaagggcggccccgggcacgaggagcccatccccatgagcacctacggctggaacctggtccggctccagtccggggtggacgtgttcttcacgccgcccgagaagtgcgacaccctgctgtgcgacatcggcgagagctcccccaaccccaccatcgaggccgggcgcaccctccgggtcctgaacctggtggagaactggctcaacaacaacacccagttctgcatcaaggtgctgaacccgtacatgcccagcgtcatcgagaagatggaggccctgcagcgccagtacggcggcgcgctcgtgcggaaccccctgtcccgcaacagcacgcacgagatgtactgggtgtccaacgccaccgggaacatcgtcagctccgtgaacatgatcagccggatgctgatcaaccgcttcaccatgaagcacaagaaggccacctacgagccggacgtggacctgggctccgggacgcggaacatcggcatcgagagcgagatccccaacctcgacatcatcgggaagcgcatcgagaagatcaagcaggagcacgagatctcctggcactacgaccaggaccacccctacaagacctgggcctaccacggcagctacgagaccaagcagaccggctccgccagctccatggtcaacggggtggtgcgcctgctgacgaagccctgggacgtcgtgccgatggtgacccagatggcgatgaccgacaccacgcccttcggccagcagcgggtcttcaaggagaaggtggacacccgcacccaggagcccaaggaggggaccaagaagctcatgaagatcacggccgagtggctgtggaaggagctgggcaagaagaagacgccccggatgtgcacccgcgaggagttcaccaagaaggtgcggagcaacgccgccctcggcgccatcttcacggacgagaacaagtggaagtccgcgcgcgaggccgtcgaggacgggcggttctgggagctggtggaccgcgagcggaacctgcacctcgagggcaagtgcgagacctgcgtgtacaacatgatggggaagcgcgagaagaagctgggcgagttcgggaaggccaagggcagccgggccatctggtacatgtggctgggcgcgcgcttcctcgagttcgaggccctggggttcctgaacgaggaccactggttcagccggggcaactccctcagcggggtcgagggcgaggggctgcaccgcctgggctacatcctccgggacgtgggcaagaaggagggcggcgccatgtacgccgacgacaccgccgggtgggacacccgcatcacgctggaggacctgaagaacgaggagatggtcaccaaccacatgaagggcgagcacaagaagctcgcggaggccatcttcaagctgacctaccagaacaaggtggtgcgggtccagcgcccgacgccccgggggacggtgatggacatcatctcccgccgggaccagcgcggcagcggccaggtggggacctacggcctgaacaccttcaccaacatggaggcccagctcatccgccagatggagggggagggcatcttcaagtccatccagcacctgacggccaccgaggagatcgccgtccagaactggctggcgcgggtgggccgcgagcggctcagccgcatggccatctccggggacgactgcgtggtcaagcccatcgacgaccggttcgccagcgccctgaccgccctgaacgacatgggcaaggtgcgcaaggacatccagcagtgggagccctcccgggggtggaacgactggacccaggtgccgttctgcagccaccacttccacgagctcgtcatgaaggacggccgcgtgctggtggtcccctgccggaaccaggacgagctgatcgggcgcgcgcggatctcccagggcgccggctggagcctcaaggagacggcctgcctggggaagtcctacgcccagatgtggaccctgatgtacttccaccgccgggacctccgcctggccgcgaacgccatctgcagcgccgtgccctcccactgggtgcccaccagccggaccacctggtccatccacgccaagcacgagtggatgacgaccgaggacatgctggcggtctggaaccgcgtgtggatccaggagaacccgtggatggaggacaagacccccgtggagagctgggaggaggtcccctacctcggcaagcgggaggaccagtggtgcgggagcctgatcggcctgacctcccgcgccacgtgggccaagaacatccagaccgccatcaaccaggtgcggagcctcatcgggaacgaggagtacaccgactacatgccctccatgaagcgcttccgccgggaggaggaggaggccggcgtgctgtggtga

SEQ ID NO: 9213 - RNA, 9876 nt, synthetic construct
  misc_feature 1..9876: note = derived and/or modified CDS sequence (opt1) from DENV-2__EU482624__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggccaacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacatccagggcagcaactggatccagaaggagaccctggtgacgttcaagaacccccacgcgaagaagcaggacgtcgtggtcctcgggtcccaggagggcgccatgcacaccgccctgaccggggccaccgagatccagatgagcagcggcaacctcctgttcacgggccacctgaagtgccgcctgcggatggacaagctccagctgaaggggatgtcctacagcatgtgcaccggcaagttcaagatcgtgaaggagatcgccgagacccagcacgggaccatcgtgatccgcgtccagtacgagggcgacggctccccctgcaagatccccttcgagatcacggacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggaccatgaagatcctgatcggcgtcatcatcacgtggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtgttcacgaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtggtcgtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcaccaagcacgcgatcctgctcgtggccgtcagcttcgtgacgctgatcaccgggaacatgtccttccgggacctgggccgcgtgatggtcatggtgggggccaccatgaccgacgacatcggcatgggcgtgacgtacctcgccctgctggccgcgttcaaggtccgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtgctgaagatcgtgcgcaacatggagaagtaccagctcgccgtcaccatcatggccatctcctgcgtgccgaacgccgtgatcctgcagaacgcgtggaaggtcagctgcacgatcctggccgccgtgtccgtcagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtgggcatggtgagcatcctcgcctccagcctgctgaagaacgacatccccatgaccgggcccctcgtcgcgggcgggctgctgacggtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagaccctgacgatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacaccatgtggcacgtcacgcggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacaccggcacgatcggggccgtcagcctggacttctcccccggcaccagcggctcccccatcgtggaccggaaggggaaggtggtcggcctctacgggaacggcgtggtgacccgcagcggcgcctacgtctccgccatcgcgcagaccgagaagtccatcgaggacaaccccgagatcgaggacgacatcttccggaagaagcgcctgacgatcatggacctgcaccccggggccggcaagaccaagcggtacctccccgccatcgtgcgcgaggccatcaagcgggggctgcgcaccctgatcctggccccgacccgcgtggtcgcggccgagatggaggaggccctccggggcctgcccatccgctaccagacgcccgccatcaagaccgagcacaccgggcgggagatcgtggacctgatgtgccacgccaccttcacgatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagaccttcgactccgagtacgtcaagacgcgggccaacgactgggacttcgtggtgaccaccgacatcagcgagatgggcgccaacttcaaggccgagcgcgtcatcgacccccggcgctgcatgaagcccgtgatcctgaccgacggggaggagcgggtgatcctcgcgggccccatgccggtcacgcactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggaccaaggagggggagcgcaagaagctcaagccgcggtggctggacgcccgcatctacagcgaccccctggccctcaaggagttcaaggagttcgccgcgggccggaagtccctgacgctgaacctcatcaccgagatgggccgcctgcccaccttcatgacccagaaggcccggaacgccctggacaacctcgccgtcctgcacacggccgaggccgggggccgcgcctacaaccacgccctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacgtacgtggtgatcgccatcctcaccgtcgtggccgcgaccatggccaacgagatgggcttcctggagaagaccaagaaggacctggggctcggcagcatcacgacccaggagagcgagtccaacatcctggacatcgacctgcgcccggccagcgcctggaccctctacgccgtggcgaccacgttcgtcacccccatgctgcggcactccatcgagaacagctccgtgaacgtgagcctgaccgccatcgccaaccaggccaccgtcctcatgggcctggggaagggctggcccctgtccaagatggacatcggggtgcccctcctggcgatcggctgctacagccaggtgaacccgatcacgctgaccgccgccctcctgctgctcgtcgcccactacgccatcatcgggcccggcctgcaggcgaaggccacccgcgaggcccagaagcgggccgccgcgggcatcatgaagaaccccaccgtggacgggatcacggtgatcgacctggagcccatcccgtacgaccccaagttcgagaagcagctcggccaggtcatgctgctgatcctctgcgtgacccaggtgctgatgatgcgcaccacctgggccctgtgcgaggccctcacgctggccaccgggcccatctccaccctgtgggagggcaaccccgggcggttctggaacaccacgatcgccgtcagcatggcgaacatcttccgcggctcctacctcgccggcgccgggctgctgttcagcatcatgaagaacaccacctccacccgccggggcacggggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagaccgaccaccacgccgtgtcccgggggagcgccaagctgcgctggttcgtcgagcggaacatggtgacgccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacctacgggtggaacctggtccgcctccagagcggcgtggacgtgttcttcaccccgcccgagaagtgcgacacgctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacccacgagatgtactgggtgagcaacgccacgggcaacatcgtctccagcgtgaacatgatctcccgcatgctgatcaaccggttcaccatgaagcacaagaaggccacctacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacgtgggcctaccacggctcctacgagaccaagcagaccgggagcgcctccagcatggtcaacggcgtggtgcgcctgctgaccaagccctgggacgtcgtgccgatggtgacgcagatggcgatgaccgacaccacccccttcgggcagcagcgcgtcttcaaggagaaggtggacacgcggacccaggagcccaaggagggcaccaagaagctcatgaagatcaccgccgagtggctgtggaaggagctgggcaagaagaagacgccccgcatgtgcacccgggaggagttcaccaagaaggtgcgctccaacgccgccctcggggccatcttcaccgacgagaacaagtggaagtccgcgcgggaggccgtcgaggacggccgcttctgggagctggtggaccgggagcgcaacctgcacctcgaggggaagtgcgagacgtgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacccggatcaccctggaggacctgaagaacgaggagatggtcacgaaccacatgaagggggagcacaagaagctcgcggaggccatcttcaagctgacctaccagaacaaggtggtgcgcgtccagcggccgacgccccgcggcaccgtgatggacatcatcagccggcgcgaccagcggggctccgggcaggtcggcacgtacgggctgaacaccttcaccaacatggaggcccagctcatccgccagatggagggcgagggcatcttcaagagcatccagcacctgaccgccacggaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagaccgcctgcctgggcaagagctacgcccagatgtggacgctgatgtacttccaccggcgcgacctccggctggccgcgaacgccatctgctccgccgtgcccagccactgggtgcccacctcccgcaccacctggagcatccacgccaagcacgagtggatgaccacggaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacctgggccaagaacatccagacggccatcaaccaggtgcgctccctcatcggcaacgaggagtacaccgactacatgcccagcatgaagcggttccgccgcgaggaggaggaggccggcgtgctgtggtga

SEQ ID NO: 9214 - RNA, 9876 nt, synthetic construct
  misc_feature 1..9876: note = derived and/or modified CDS sequence (opt1) from DENV-2__EU596500__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatggtgatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcatcggcacgaagcacgcgatcctgctcgtcgccgtgagcttcgtgaccctgatcaccgggaacatgtccttccgggacctgggccgcgtcatggtgatggtgggggccaccatgacggacgacatcggcatgggcgtcacctacctcgccctgctggccgcgttcaaggtgcgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtccgcaacatggagaagtaccagctcgccgtgacgatcatggccatctcctgcgtgccgaacgccgtcatcctgcagaacgcgtggaaggtgagctgcaccatcctggccgccgtctccgtgagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtcagcatcctcgcctccagcctgctgaagaacgacatccccatgacggggcccctcgtggcgggcgggctgctgaccgtgtgctacgtcctcaccggccggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtcttcccggtgtccatccccatcaccgcggccgcctggtacctgtgggaggtgaagaagcagcgcgccggcgtcctctgggacgtgcccagcccgccgcccgtggagaaggccgagctggaggacggggcgtaccggatcaagcagcgcggcatcctggggtactcccagatcggcgccggcgtctacaaggaggggaccttccacacgatgtggcacgtgacccggggcgccgtgctcatgcaccgcgggaagcggatcgagcccagctgggccgacgtcaagaaggacctgatctcctacggcgggggctggaagctggagggcgagtggaaggagggggaggaggtccaggtgctcgccctggagcccggcaagaacccccgcgcggtccagaccaagcccgggatcttcaagaccaacacgggcaccatcggggccgtgagcctggacttctcccccggcaccagcggctcccccatcgtggaccggaaggggaaggtcgtgggcctctacgggaacggcgtggtcacccgcagcggcgcctacgtgtccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtcgtggcggccgagatggaggaggccctccggggcctgcccatccgctaccagacccccgccatcaagaccgagcacaccgggcgggagatcgtggacctgatgtgccacgccacgttcaccatgcgcctcctgagccccgtccgggtgccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgcggcctgcctccggaagaacggcaagaaggtcatccagctgagccgcaagacgttcgactccgagtacgtgaagacccgggccaacgactgggacttcgtggtcaccaccgacatcagcgagatgggcgccaacttcaaggccgagcgcgtgatcgacccccggcgctgcatgaagcccgtgatcctgacggacggggaggagcgggtcatcctcgcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtcgacctgatgcggcgcggcgacctccccgtgtggctggcctacaaggtggccgccgaggggatcaactacgcggaccggaagtggtgcttcgacggcatcaagaacaaccagatcctggaggagaacatggaggtcgagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtgctgcacaccgccgaggccgggggccgcgcctacaaccacgccctgagcgagctccccgagaccctggagaccctgctcctgctgacgctcctggccaccgtcaccgggggcatcttcctgttcctcatgtccggcaagagcatcgggaagatgaccctgggcatgtgctgcatcatcaccgcctccatcctgctctggcacgcgcagatccagccgcactggatcgccgccagcatcatcctggagttcttcctgatcgtgctcctgatccccgagcccgagaagcagcggacgccccaggacaaccagctgacctacgtggtcatcgccatcctcaccgtggtggccgcgaccatggccaacgagatggggttcctggagaagacgaagaaggacctgggcctcgggagcatcaccacccaggagtccgagagcaacatcctggacatcgacctgcgcccggcctccgcctggaccctctacgccgtcgcgacgaccttcgtgacccccatgctgcggcacagcatcgagaactccagcgtgaacgtctccctgaccgccatcgccaaccaggccacggtgctcatgggcctgggcaaggggtggcccctgagcaagatggacatcggcgtgcccctcttcgcgatcgggtgctactaccaggtcaacccgatcaccctgaccgccgccctgctcctgctggtggcccacaacgccatcatcggccaggggctccaggcgaaggccacccgcgaggcccagaagcgggccgccgcgggcatcatgaagaaccccacggtggacggcatcaccgtcatcgacctggagcccatcccctacgacccgaagttcgagaagcagctgggccaggtgatgctcctgatcctgtgcgtgacccaggtcctcatgatgcgcaccacgtgggccctgtgcgaggccctgaccctcgccaccggccccatctccaccctgtgggaggggaaccccggccggttctggaacacgaccatcgccgtgagcatggcgaacatcttccgcgggtcctacctggccggcgccggcctcctgttcagcatcatgaagaacaccacctccacgcgccgggggaccggcaacatcggggagaccctgggcgagaagtggaagtcccgcctcaacgccctgggcaagtccgagttccagatctacaagaagtccgggatccaggaggtggaccggaccctggcgaaggagggcatcaagcgcggggagacggaccaccacgccgtctcccggggcagcgccaagctccgctggttcgtggagcggaacatggtgacccccgaggggaaggtcgtggacctgggctgcggccgcgggggctggtcctactactgcgggggcctgaagaacgtgcgggaggtcaaggggctcaccaagggcggcccggggcacgaggagcccatccccatgagcacctacggctggaacctggtgcgcctgcagagcggggtggacgtcttcttcacgcccccggagaagtgcgacaccctcctgtgcgacatcggcgagtccagccccaaccccaccatcgaggccgggcggaccctgcgcgtgctcaacctggtggagaactggctgaacaacaacacccagttctgcatcaaggtcctcaacccctacatgccgtccgtgatcgagaagatggaggccctgcagcggcagtacggcggcgcgctggtgcgcaaccccctcagccggaactccacgcacgagatgtactgggtcagcaacgccaccgggaacatcgtgtccagcgtgaacatgatctcccgcatgctgatcaaccggttcaccatgaagcacaagaaggccacctacgagcccgacgtcgacctgggcagcgggacgcgcaacatcggcatcgagaacgagatcccgaacctggacatcatcgggaagcggatcgagaagatcaagcaggagcacgagatctcctggcactacgaccaggaccacccctacaagacctgggcctaccacggcagctacgagaccaagcagaccggctccgccagctccatggtgaacggggtggtccgcctcctgacgaagccctgggacgtggtgcccatggtcacccagatggcgatgaccgacaccacgccgttcggccagcagcgcgtgttcaaggagaaggtggacacccggacccaggagcccaaggaggggaccaagaagctgatgaagatcacggccgagtggctctggaaggagctgggcaagaagaagacgccccgcatgtgcacccgggaggagttcacccgcaaggtccggagcaacgccgccctgggcgccatcttcacggacgagaacaagtggaagtccgcgcgcgaggccgtggaggacgggcggttctgggagctcgtggaccgcgagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccggggcaacagcctgagcggggtggagggcgaggggctccaccgcctgggctacatcctgcgggacgtcggcaagaaggagggcggcgccatgtacgccgacgacaccgccgggtgggacacccgcatcacgctcgaggacctgaagaacgaggagatggtgaccaaccacatgaagggcgagcacaagaagctggcggaggccatcttcaagctcacctaccagaacaaggtggtccgggtgcagcgccccaccccgcgggggacggtgatggacatcatctcccgccgggaccagcgcggcagcggccaggtcgggacctacggcctgaacaccttcaccaacatggaggcccagctgatccgccagatggagggggagggcatcttcaagtccatccagcacctcacggccaccgaggagatcgccgtgcagaactggctggcgcgggtgggccgcgagcggctgagccgcatggccatctccggggacgactgcgtcgtgaagcccatcgacgaccggttcgccagcgccctcaccgccctgaacgacatgggcaaggtgcgcaaggacatccagcagtgggagccctcccgggggtggaacgactggacccaggtccccttctgcagccaccacttccacgagctggtgatgaaggacggccgcgtgctcgtcgtgccgtgccggaaccaggacgagctgatcgggcgcgcgcggatctcccagggcgccggctggagcctgaaggagacggcctgcctcgggaagtcctacgcccagatgtggaccctgatgtacttccaccgccgggacctgcgcctcgccgcgaacgccatctgcagcgccgtgccctcccactgggtccccaccagccggaccacctggtccatccacgccaagcacgagtggatgacgaccgaggacatgctggcggtgtggaaccgcgtgtggatccaggagaacccctggatggaggacaagaccccggtcgagagctgggaggaggtgccctacctgggcaagcgggaggaccagtggtgcgggtccctcatcggcctgaccagccgcgccacgtgggccaagaacatccagaccgccatcaaccaggtgcggagcctgatcgggaacgaggagtacaccgactacatgccctccatgaagcgcttccgccgggaggaggaggaggccggcgtcctctggtga

SEQ ID NO: 9215 - RNA, 9876 nt, synthetic construct
  misc_feature 1..9876: note = derived and/or modified CDS sequence (opt1) from DENV-2__EU482626__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacatccagggcagcaactggatccagaaggagaccctggtgacgttcaagaacccccacgcgaagaagcaggacgtcgtggtcctcgggtcccaggagggcgccatgcacaccgccctgaccggggccaccgagatccagatgagcagcggcaacctcctgttcacgggccacctgaagtgccgcctgcggatggacaagctccagctgaaggggatgtcctacagcatgtgcaccggcaagttcaagatcgtgaaggagatcgccgagacccagcacgggaccatcgtgatccgcgtccagtacgagggcgacggctccccctgcaagatccccttcgagatcacggacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggaccatgaagatcctgatcggcgtcatcatcacgtggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccgcagcccacccagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtgttcacgaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtggtcgtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcaccaagcacgcgatcctgctcgtggccgtcagcttcgtgacgctgatcaccgggaacatgtccttccgggacctgggccgcgtgatggtcatggtgggggccaccatgaccgacgacatcggcatgggcgtgacgtacctcgccctgctggccgcgttcaaggtccgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtgctgaagatcgtgcgcaacatggagaagtaccagctcgccgtcaccatcatggccatctcctgcgtgccgaacgccgtgatcctgcagaacgcgtggaaggtcagctgcacgatcctggccgccgtgtccgtcagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtgggcatggtgagcatcctcgcctccagcctgctgaagaacgacatccccatgaccgggcccctcgtcgcgggcgggctgctgacggtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagaccctgacgatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacaccatgtggcacgtcacgcggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacaccggcacgatcggggccgtcagcctggacttctcccccggcaccagcggctcccccatcgtggaccggaaggggaaggtggtcggcctctacgggaacggcgtggtgacccgcagcggcgcctacgtctccgccatcgcgcagaccgagaagtccatcgaggacaaccccgagatcgaggacgacatcttccggaagaagcgcctgacgatcatggacctgcaccccggggccggcaagaccaagcggtacctccccgccatcgtgcgcgaggccatcaagcgggggctgcgcaccctgatcctggccccgacccgcgtggtcgcggccgagatggaggaggccctccggggcctgcccatccgctaccagacgcccgccatcaagaccgagcacaccgggcgggagatcgtggacctgatgtgccacgccaccttcacgatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagaccttcgactccgagtacgtcaagacgcgggccaacgactgggacttcgtggtgaccaccgacatcagcgagatgggcgccaacttcaaggccgagcgcgtcatcgacccccggcgctgcatgaagcccgtgatcctgaccgacggggaggagcgggtgatcctcgcgggccccatgccggtcacgcactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggaccaaggagggggagcgcaagaagctcaagccgcggtggctggacgcccgcatctacagcgaccccctggccctcaaggagttcaaggagttcgccgcgggccggaagtccctgacgctgaacctcatcaccgagatgggccgcctgcccaccttcatgacccagaaggcccggaacgccctggacaacctcgccgtcctgcacacggccgaggccgggggccgcgcctacaaccacgccctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacgtacgtggtgatcgccatcctcaccgtcgtggccgcgaccatggccaacgagatgggcttcctggagaagaccaagaaggacctggggctcggcagcatcacgacccaggagagcgagtccaacatcctggacatcgacctgcgcccggccagcgcctggaccctctacgccgtggcgaccacgttcgtcacccccatgctgcggcactccatcgagaacagctccgtgaacgtgagcctgaccgccatcgccaaccaggccaccgtcctcatgggcctggggaagggctggcccctgtccaagatggacatcggggtgcccctcctggcgatcggctgctacagccaggtgaacccgatcacgctgaccgccgccctcctgctgctcgtcgcccactacgccatcatcgggcccggcctgcaggcgaaggccacccgcgaggcccagaagcgggccgccgcgggcatcatgaagaaccccaccgtggacgggatcacggtgatcgacctggagcccatcccgtacgaccccaagttcgagaagcagctcggccaggtcatgctgctgatcctctgcgtgacccaggtgctgatgatgcgcaccacctgggccctgtgcgaggccctcacgctggccaccgggcccatctccaccctgtgggagggcaaccccgggcggttctggaacaccacgatcgccgtcagcatggcgaacatcttccgcggctcctacctcgccggcgccgggctgctgttcagcatcatgaagaacaccacctccacccgccggggcacggggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagaccgaccaccacgccgtgtcccgggggagcgccaagctgcgctggttcgtcgagcggaacatggtgacgccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacctacgggtggaacctggtccgcctccagagcggcgtggacgtgttcttcaccccgcccgagaagtgcgacacgctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacccacgagatgtactgggtgagcaacgccacgggcaacatcgtctccagcgtgaacatgatctcccgcatgctgatcaaccggttcaccatgaagcacaagaaggccacctacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacgtgggcctaccacggctcctacgagaccaagcagaccgggagcgcctccagcatggtcaacggcgtggtgcgcctgctgaccaagccctgggacgtcgtgccgatggtgacgcagatggcgatgaccgacaccacccccttcgggcagcagcgcgtcttcaaggagaaggtggacacgcggacccaggagcccaaggagggcaccaagaagctcatgaagatcaccgccgagtggctgtggaaggagctgggcaagaagaagacgccccgcatgtgcacccgggaggagttcaccaagaaggtgcgctccaacgccgccctcggggccatcttcaccgacgagaacaagtggaagtccgcgcgggaggccgtcgaggacggccgcttctgggagctggtggaccgggagcgcaacctgcacctcgaggggaagtgcgagacgtgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacccggatcaccctggaggacctgaagaacgaggagatggtcacgaaccacatgaagggggagcacaagaagctcgcggaggccatcttcaagctgacctaccagaacaaggtggtgcgcgtccagcggccgacgccccgcggcaccgtgatggacatcatcagccggcgcgaccagcggggctccgggcaggtcggcacgtacgggctgaacaccttcaccaacatggaggcccagctcatccgccagatggagggcgagggcatcttcaagagcatccagcacctgaccgccacggaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagaccgcctgcctgggcaagagctacgcccagatgtggacgctgatgtacttccaccggcgcgacctccggctggccgcgaacgccatctgctccgccgtgcccagccactgggtgcccacctcccgcaccacctggagcatccacgccaagcacgagtggatgaccacggaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacctgggccaagaacatccagacggccatcaaccaggtgcgctccctcatcggcaacgaggagtacaccgactacatgcccagcatgaagcggttccgccgcgaggaggaggaggccggcgtgctgtggtga

SEQ ID NO: 9216 - RNA, 9876 nt, synthetic construct
  misc_feature 1..9876: note = derived and/or modified CDS sequence (opt1) from DENV-2__EU482629__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtcttcggcgcgatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccggccgggctaccacacgcagaccgcggggccctggcacctcggcaagctggagatggacttcgacctgtgcgaggggaccaccgtcgtggtgacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtcaacagcctcgtgaccgccgggcacggccagatcgacaacttctccctgggcgtgctggggatggccctcttcctggaggagatgctgcgcacccggatcggcacgaagcacgcgatcctcctggtcgccgtgagcttcgtgaccctgatcaccgggaacatgtccttcaaggacctcggccgcgtcatggtgatgatgggggccaccatgacggacgacatcggcatgggcgtgacctacctggccctgctcgccgcgttcaaggtccgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtgctcaagatcgtgcgcaacatggagaagtaccagctggccgtcacgatcatggccatctcctgcgtgccgaacgccgtgatcctgcagaacgcgtggaaggtcagctgcaccatcctcgccgccgtgtccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtcgcgggcgggctgctcaccgtgtgctacgtgctgaccggccggagcgccgacctggagctcgagcgcgccgccgacgtcaagtgggaggaccaggccgagatctccgggagctcccccatcctgagcatcaccatctccgaggacggcagcatgtccatcaagaacgaggaggaggagcagacgctgaccatcctcatccggaccggcctgctggtgatcagcggggtgttcccggtctccatccccatcaccgcggccgcctggtacctctgggaggtgaagaagcagcgcgccggcgtgctgtgggacgtccccagcccgccgcccgtggagaaggccgagctggaggacggggcgtaccggatcaagcagcgcggcatcctcgggtactcccagatcggcgccggcgtgtacaaggaggggaccttccacacgatgtggcacgtcacccggggcgccgtgctgatgcaccgcgggaagcggatcgagcccagctgggccgacgtgaagaaggacctgatctcctacggcgggggctggaagctcgagggcgagtggaaggagggggaggaggtccaggtgctggccctggagcccggcaagaacccccgcgcggtgcagaccaagcccgggatcttcaagaccaacacgggcaccatcggggccgtcagcctcgacttctcccccggcaccagcggctcccccatcgtggaccggaaggggaaggtggtcggcctgtacgggaacggcgtggtgacccgcagcggcgcctacgtctccgccatcgcgcagacggagaagtccatcgaggacaaccccgagatcgaggacgacatcttccggaagaagcgcctgaccatcatggacctccaccccggggccggcaagaccaagcggtacctgcccgccatcgtgcgcgaggccatcaagcgggggctgcgcaccctgatcctcgccccgacgcgcgtggtcgcggccgagatggaggaggccctgcggggcctgcccatccgctaccagaccaccgccatcaagaccgagcacacggggcgggagatcgtggacctcatgtgccacgccaccttcaccatgcgcctgctgagccccgtgcgggtccccaactacaacctcatcatcatggacgaggcgcacttcaccgacccggcctccatcgccgcccgcggctacatcagcacgcgggtggagatgggcgaggccgcggggatcttcatgaccgccacgccgcccggctcccgcgaccccttcccgcagagcaacgcccccatcatggacgaggagcgggagatccccgagcgctcctggaacagcgggcacgagtgggtgaccgacttcaagggcaagacggtctggttcgtgccctccatcaaggccgggaacgacatcgcggcctgcctgcggaagaacggcaagaaggtgatccagctgagccgcaagaccttcgactccgagtacgtcaagacccgggccaacgactgggacttcgtggtgaccacggacatcagcgagatgggcgccaacttcaaggccgagcgcgtcatcgacccgcggcgctgcatgaagcccgtgatcctcaccgacggggaggagcgggtgatcctggcgggccccatgcccgtcacccactccagcgccgcccagcgccgggggcgcatcggccgcaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgggagaaggtggacgcgatcgacggcgagtaccgcctgcgcggggaggcccgcaagacgttcgtggacctcatgcggcgcggcgacctgcccgtctggctggcctacaaggtggccgccgaggggatcaactacgcggaccggaagtggtgcttcgacggcatcaagaacaaccagatcctcgaggagaacatggaggtggagatctggaccaaggagggggagcgcaagaagctgaagccccggtggctggacgcccgcatctacagcgacccgctcgccctgaaggagttcaaggagttcgccgcgggccggaagtccctgaccctcaacctgatcaccgagatgggccgcctgcccacgttcatgacccagaaggcccggaacgccctcgacaacctggccgtcctgcacaccgccgaggccgggggccgcgcctacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcggacgccccaggacaaccagctcacctacgtcgtgatcgccatcctgaccgtcgtggccgcgacgatggccaacgagatgggcttcctggagaagaccaagaaggacctcgggctgggcagcatcaccacccaggagagcgagtccaacatcctggacatcgacctccgccccgccagcgcctggacgctgtacgccgtggcgaccaccttcatcaccccgatgctgcggcactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgcgaggcccagaagcgggccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcgcacgacctgggccctctgcgaggccctgaccctggccaccgggcccatctccacgctctgggagggcaaccccgggcggttctggaacaccaccatcgccgtgagcatggcgaacatcttccgcggctcctacctggccggcgccgggctcctgttcagcatcatgaagaacaccacgaacacccgccggggcaccgggaacatcggcgagaccctgggcgagaagtggaagtcccgcctgaacgccctcggcaagagcgagttccagatctacaagaagtccggcatccaggaggtcgaccggacgctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggccgggccacgaggagcccatccccatgtccacgtacgggtggaacctcgtgcgcctgcagagcggcgtcgacgtgttcttcacgccgcccgagaagtgcgacaccctgctctgcgacatcggggagagctcccccaaccccaccatcgaggccggccggaccctgcgcgtgctgaacctcgtcgagaactggctgaacaacaacacgcagttctgcatcaaggtgctgaacccctacatgcccagcgtgatcgagaagatggaggccctccagcggaagtacggcggggcgctggtccgcaaccccctgtcccggaacagcacccacgagatgtactgggtgtccaacgccaccggcaacatcgtgagctccgtcaacatgatcagccgcatgctgatcaaccggttcaccatgaagcacaagaaggccacgtacgagcccgacgtggacctcgggtccggcacccgcaacatcgggatcgagagcgagatcccgaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgcgtgttcaaggagaaggtcgacacccggacgcaggagcccaaggagggcaccaagaagctgatgaagatcaccgccgagtggctgtggaaggagctcggcaagaagaagacgccccgcatgtgcacgcgggaggagttcacccgcaaggtgcggagcaacgccgccctgggggccatcttcaccgacgagaacaagtggaagtccgcgcgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggccatctggtacatgtggctcggggcgcgcttcctggagttcgaggccctgggcttcctcaacgaggaccactggttctcccgggggaacagcctgagcggcgtggagggggagggcctgcaccgcctcggctacatcctgcgggacgtcgggaagaaggagggcggggccatgtacgccgacgacacggccggctgggacacccgcatcaccctggaggacctcaagaacgaggagatggtgaccaaccacatgaagggggagcacaagaagctggcggaggccatcttcaagctgacgtaccagaacaaggtggtccgggtgcagcgccccaccccgcggggcaccgtcatggacatcatctcccgccgggaccagcgcggcagcgggcaggtcggcacctacgggctcaacacgttcaccaacatggaggcccagctgatccgccagatggagggcgagggcatcttcaagtccatccagcacctgaccgccaccgaggagatcgccgtgcagaactggctcgcgcgggtcgggcgcgagcggctgagccgcatggccatctccggcgacgactgcgtggtgaagcccatcgacgaccggttcgccagcgccctgacggccctcaacgacatggggaagatccgcaaggacatccagcagtgggagccctcccggggctggaacgactggacccaggtccccttctgcagccaccacttccacgagctggtgatgaaggacgggcgcgtgctggtcgtgccgtgccggaaccaggacgagctcatcggccgcgcgcggatctcccagggcgccgggtggagcctgaaggagaccgcctgcctgggcaagtcctacgcccagatgtggaccctcatgtacttccaccgccgggacctgcgcctggccgcgaacgccatctgcagcgccgtgccctcccactgggtccccaccagccggacgacctggtccatccacgccaagcacgagtggatgaccaccgaggacatgctcgcggtgtggaaccgcgtgtggatccaggagaacccctggatggaggacaagacgccggtcgagagctgggaggaggtgccctacctggggaagcgggaggaccagtggtgcggctccctgatcgggctcaccagccgcgccacctgggccaagaacatccagaccgccatcaaccaggtgcggagcctgatcggcaacgaggagtacacggactacatgccctccatgaagcgcttccgccgggaggaggaggaggccggcgtcctgtggtga

SEQ ID NO: 9217 - RNA, 9876 nt, synthetic construct
  misc_feature 1..9876: note = derived and/or modified CDS sequence (opt1) from DENV-2__FJ390390__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgaagttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggacaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcctgctggaggagatgctccgcacccggatcggcacgaagcacgcgatcctgctggtggccgtgagcttcgtcaccctcatcaccgggaacatgtccttccgcgacctgggccgcgtgatggtgatggtcggggccaccatgacggacgacatcggcatgggcgtgacctacctggccctcctggccgcgttcaaggtgcggcccaccttcgccgccgggctgctcctgcgcaagctgaccagcaaggagctcatgatggccacgatcggcatcgccctgctgtcccagagcaccatccccgagaccatcctcgagctgaccgacgcgctggccctcgggatgatggtcctgaagatcgtgcggaacatggagaagtaccagctggccgtgacggtcatggccatctcctgcgtgccgaacgccgtgatcctccagaacgcgtggaaggtcagctgcaccatcctggccgccgtgtccgtcagccccctgctcctgacctccagccagcagaaggccgactggatccccctggcgctcaccatcaagggcctgaaccccacggccatcttcctgaccaccctctcccgcaccagcaagaagcggtcctggccgctgaacgaggccatcatggccgtgggcatggtgagcatcctggcctccagcctcctgaagaacgacatccccatgacggggcccctggtcgcgggcgggctcctgaccgtgtgctacgtgctgaccggccgcagcgccgacctcgagctggagcgggccgccgacgtcaagtgggaggaccaggccgagatctccgggagctcccccatcctgagcatcaccatctccgaggacggcagcatgtccatcaagaacgaggaggaggagcagacgctcaccatcctgatccgcaccggcctgctcgtgatcagcggggtgttcccggtctccatccccatcaccgcggccgcctggtacctgtgggaggtgaagaagcagcgggccggcgtgctgtgggacgtccccagcccgccgcccgtggagaaggccgagctcgaggacggggcgtaccgcatcaagcagcggggcatcctggggtactcccagatcggcgccggcgtgtacaaggaggggaccttccacacgatgtggcacgtcacccgcggcgccgtgctgatgcaccgggggaagcgcatcgagcccagctgggccgacgtgaagaaggacctcatctcctacggcgggggctggaagctggagggcgagtggaaggagggggaggaggtccaggtgctggccctcgagcccggcaagaacccccgggcggtgcagaccaagcccgggatcttcaagaccaacacgggcaccatcggggccgtcagcctggacttctcccccggcaccagcggctcccccatcgtggaccgcaaggggaaggtggtcggcctgtacgggaacggcgtggtgacccggagcggcgcctacgtctccgccatcgcgcagacggagaagtccatcgaggacaaccccgagatcgaggacgacatcttccgcaagaagcggctcaccatcatggacctgcaccccggggccggcaagaccaagcgctacctgcccgccatcgtgcgggaggccatcaagcgcgggctgcgcaccctcatcctggccccgacgcgggtggtcgcggccgagatggaggaggccctgcgcggcctccccatccggtaccagaccaccgccatcaagaccgagcacacggggcgcgagatcgtggacctgatgtgccacgccaccttcaccatgcggctgctcagccccgtgcgcgtccccaactacaacctgatcatcatggacgaggcgcacttcaccgacccggcctccatcgccgcccggggctacatcagcacgcgcgtggagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtctggttcgtgccctccatcaaggccgggaacgacatcgcggcctgcctgcgcaagaacggcaagaaggtgatccagctcagccggaagaccttcgactccgagtacgtcaagacccgcgccaacgactgggacttcgtggtgaccacggacatcagcgagatgggcgccaacttcaaggccgagcgggtcatcgacccgcgccggtgcatgaagcccgtgatcctgaccgacggggaggagcgcgtgatcctggcgggccccatgcccgtcacccactccagcgccgcccagcggcgcgggcgcatcggccggaacccgaagaacgagaacgaccagtacatctacatgggggagcccctcgagaacgacgaggactgcgcccactggaaggaggccaagatgctgctggacaacatcaacacccccgagggcatcatcccctccatgttcgagccggagcgcgagaaggtggacgcgatcgacggcgagtaccggctccgcggggaggcccggaagacgttcgtggacctgatgcgccggggcgacctgcccgtctggctcgcctacaaggtggccgccgaggggatcaactacgcggaccgcaagtggtgcttcgacggcatcaagaacaaccagatcctggaggagaacatggaggtggagatctggaccaaggagggggagcggaagaagctgaagccccgctggctcgacgcccggatctacagcgacccgctggccctgaaggagttcaaggagttcgccgcgggccgcaagtccctcaccctgaacctgatcaccgagatgggccggctccccacgttcatgacccagaaggcccgcaacgccctggacaacctggccgtcctccacaccgccgaggccgggggccgggcctacaaccacgccctgagcgagctgcccgagaccctcgagacgctgctgctcctgaccctgctcgccaccgtgaccgggggcatcttcctgttcctgatgtccggcaaggggatcggcaagatgaccctcgggatgtgctgcatcatcacggccagcatcctgctgtggtacgcgcagatccagccccactggatcgccgcctccatcatcctcgagttcttcctgatcgtcctgctcatcccggagcccgagaagcagcgcacgccccaggacaaccagctgacctacgtggtgatcgccatcctgaccgtcgtggccgcgacgatggccaacgagatgggcttcctcgagaagaccaagaaggacctggggctgggcagcatcaccacccaggagagcgagtccaacatcctcgacatcgacctgcggcccgccagcgcctggacgctgtacgccgtggcgaccaccttcgtcaccccgatgctccgccactccatcgagaacagctccgtgaacgtgagcctgacggccatcgccaaccaggccaccgtcctgatgggcctcgggaagggctggcccctgtccaagatggacatcggggtgcccctgctcgcgatcggctgctacagccaggtgaaccccatcaccctgaccgccgccctgctcctgctggtcgcccactacgccatcatcgggccgggcctccaggcgaaggccacgcgggaggcccagaagcgcgccgccgcgggcatcatgaagaaccccaccgtggacgggatcaccgtgatcgacctggagcccatcccctacgacccgaagttcgagaagcagctgggccaggtcatgctcctgatcctgtgcgtgacccaggtgctcatgatgcggacgacctgggccctgtgcgaggccctgaccctcgccaccgggcccatctccacgctgtgggagggcaaccccgggcgcttctggaacaccaccatcgccgtcagcatggcgaacatcttccgcggctcctacctggccggcgccgggctcctgttcagcatcatgaagaacaccacgaacacccggcgcggcaccgggaacatcggcgagaccctgggcgagaagtggaagtcccggctcaacgccctgggcaagagcgagttccagatctacaagaagtccggcatccaggaggtggaccgcacgctggcgaaggaggggatcaagcggggcgagaccgaccaccacgccgtgagccgcgggtccgccaagctccggtggttcgtcgagcgcaacatggtgacccccgagggcaaggtggtcgacctgggctgcgggcggggcgggtggagctactactgcggcgggctgaagaacgtgcgcgaggtgaagggcctcaccaagggcgggccgggccacgaggagcccatccccatgtccacgtacgggtggaacctggtccggctgcagagcggcgtggacgtgttcttcacgccgcccgagaagtgcgacaccctcctgtgcgacatcggggagagctcccccaaccccaccatcgaggccggccgcaccctgcgggtcctcaacctggtggagaactggctgaacaacaacacgcagttctgcatcaaggtgctcaacccctacatgcccagcgtcatcgagaagatggaggccctgcagcgcaagtacggcggggcgctggtgcggaaccccctgtcccgcaacagcacccacgagatgtactgggtgtccaacgccaccggcaacatcgtcagctccgtgaacatgatcagccggatgctcatcaaccgcttcaccatgaagcacaagaaggccacgtacgagcccgacgtggacctggggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtcaacggcgtggtgcgcctcctgaccaagccctgggacgtcgtgcccatggtgacccagatggcgatgacggacaccaccccgttcgggcagcagcgggtcttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcacccggaaggtgcgcagcaacgccgccctgggggccatcttcaccgacgagaacaagtggaagtccgcgcgggaggccgtcgaggacggccgcttctgggagctcgtggaccgggagcgcaacctgcacctggaggggaagtgcgagacctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgggaacagcctgagcggcgtcgagggggagggcctccaccggctgggctacatcctgcgcgacgtggggaagaaggagggcggggccatgtacgccgacgacacggccggctgggacacccggatcaccctcgaggacctgaagaacgaggagatggtcaccaaccacatgaagggggagcacaagaagctggcggaggccatcttcaagctcacgtaccagaacaaggtggtgcgcgtccagcggcccaccccgcgcggcaccgtgatggacatcatctcccggcgcgaccagcgcggcagcgggcaggtcggcacctacgggctgaacacgttcaccaacatggaggcccagctgatccggcagatggagggcgagggcatcttcaagtccatccagcacctcaccgccaccgaggagatcgccgtccagaactggctggcgcgcgtggggcgggagcgcctgagccggatggccatctccggcgacgactgcgtggtcaagcccatcgacgaccgcttcgccagcgccctcacggccctgaacgacatggggaaggtgcggaaggacatccagcagtgggagccctcccgcggctggaacgactggacccaggtgcccttctgcagccaccacttccacgagctggtcatgaaggacgggcgggtgctcgtggtcccgtgccgcaaccaggacgagctgatcggccgggcgcgcatctcccagggcgccgggtggagcctgaaggagaccgcctgcctcggcaagtcctacgcccagatgtggaccctgatgtacttccaccggcgcgacctgcggctcgccgcgaacgccatctgcagcgccgtgccctcccactgggtgcccaccagccgcacgacctggtccatccacgccaagcacgagtggatgaccaccgaggacatgctggcggtctggaaccgggtgtggatccaggagaacccctggatggaggacaagacgccggtggagagctgggaggaggtcccctacctggggaagcgcgaggaccagtggtgcggctccctcatcgggctgaccagccgggccacctgggccaagaacatccagaccgccatcaaccaggtgcgcagcctgatcggcaacgaggagtacacggactacatgccctccatgaagcgcttccggcgcgaggaggaggaggccggcgtgctctggtga

SEQ ID NO: 9218 - RNA, 9876 nt, synthetic construct
  misc_feature 1..9876: note = derived and/or modified CDS sequence (opt1) from DENV-2__FJ390391__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcttcgagctgaccgacgcgctggccctcgggatgatggtgctgaagatcgtgcgcaacatggagaagtaccagctggccgtcacgatcatggccatctcctgcgtgccgaacgccgtgatcctccagaacgcgtggaaggtcagctgcaccatcctggccgccgtgtccgtcagccccctgctcctgacctccagccagcagaaggccgactggatccccctggcgctcaccatcaagggcctgaaccccacggccatcttcctgaccaccctctcccggaccagcaagaagcgctcctggccgctgaacgaggccatcatggccgtgggcatggtgagcatcctggcctccagcctcctgaagaacgacatccccatgacggggcccctggtcgcgggcgggctcctgaccgtgtgctacgtgctgaccggccggagcgccgacctcgagctggagcgcgccgccgacgtcaagtgggaggaccaggccgagatctccgggagctcccccatcctgagcatcaccatctccgaggacggcagcatgtccatcaagaacgaggaggaggagcagacgctcaccatcctgatccggaccggcctgctcgtgatcagcggggtgttcccggtctccatccccatcaccgcggccgcctggtacctgtgggaggtgaagaagcagcgcgccggcgtgctgtgggacgtccccagcccgccgcccgtggagaaggccgagctcgaggacggggcgtaccggatcaagcagcgcggcatcctggggtactcccagatcggcgccggcgtgtacaaggaggggaccttccacacgatgtggcacgtcacccggggcgccgtgctgatgcaccgcgggaagcggatcgagcccagctgggccgacgtgaagaaggacctcatctcctacggcgggggctggaagctggagggcgagtggaaggagggggaggaggtccaggtgctggccctcgagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctgtacgggaacggcgtggtgacccgcagcggcgcctacgtctccgccatcgcgcagacggagaagtccatcgaggacaaccccgagatcgaggacgacatcttccggaagaagcgcctcaccatcatggacctgcaccccggggccggcaagaccaagcggtacctgcccgccatcgtgcgcgaggccatcaagcgggggctccgcaccctgatcctggccccgacgcgcgtggtcgcggccgagatggaggaggccctgcggggcctccccatccgctaccagacccccgccatcaagaccgagcacaccgggcgggagatcgtggacctgatgtgccacgccacgttcaccatgcgcctgctcagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctgcggaagaacggcaagaaggtgatccagctcagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctggcgggccccatgccggtcacccactccagcgccgcccagcgccgggggcgcatcggccgcaaccccaagaacgagaacgaccagtacatctacatgggggagcccctcgagaacgacgaggactgcgcccactggaaggaggccaagatgctgctggacaacatcaacacccccgagggcatcatcccgtccatgttcgagcccgagcgggagaaggtggacgcgatcgacggcgagtaccgcctccgcggggaggcccgcaagaccttcgtggacctgatgcggcgcggcgacctgcccgtctggctcgcctacaaggtggccgccgaggggatcaactacgcggaccggaagtggtgcttcgacggcatcaagaacaaccagatcctggaggagaacatggaggtggagatctggacgaaggagggggagcgcaagaagctgaagccgcggtggctcgacgcccgcatctacagcgaccccctggccctgaaggagttcaaggagttcgccgcgggccggaagtccctcaccctgaacctgatcaccgagatgggccgcctccccaccttcatgacgcagaaggcccggaacgccctggacaacctggccgtcctccacaccgccgaggccgggggccgcgcctacaaccacgccctgagcgagctgcccgagaccctcgagaccctgctgctcctgacgctgctcgccaccgtgaccgggggcatcttcctgttcctgatgtccggcaaggggatcggcaagatgaccctcgggatgtgctgcatcatcaccgccagcatcctgctgtggtacgcgcagatccagccgcactggatcgccgcctccatcatcctcgagttcttcctgatcgtcctgctcatccccgagcccgagaagcagcggacgccccaggacaaccagctgacctacgtggtgatcgccatcctgaccgtcgtggccgcgaccatggccaacgagatgggcttcctcgagaagacgaagaaggacctggggctgggcagcatcaccacccaggagagcgagtccaacatcctcgacatcgacctgcgcccggccagcgcctggaccctgtacgccgtggcgacgaccttcgtcacccccatgctccggcactccatcgagaacagctccgtgaacgtgagcctgaccgccatcgccaaccaggccacggtcctgatgggcctcgggaagggctggcccctgtccaagatggacatcggggtgcccctgctcgcgatcggctgctacagccaggtgaacccgatcaccctgaccgccgccctgctcctgctggtcgcccactacgccatcatcgggcccggcctccaggcgaaggccacccgcgaggcccagaagcgggccgccgcgggcatcatgaagaaccccacggtggacgggatcaccgtgatcgacctggagcccatcccgtacgaccccaagttcgagaagcagctgggccaggtcatgctcctgatcctgtgcgtgacccaggtgctcatgatgcgcaccacgtgggccctgtgcgaggccctgaccctcgccaccgggcccatctccaccctgtgggagggcaaccccgggcggttctggaacacgaccatcgccgtcagcatggcgaacatcttccgcggctcctacctggccggcgccgggctcctgttcagcatcatgaagaacaccacctccacgcgccggggcaccgggaacatcggcgagaccctgggcgagaagtggaagtcccgcctcaacgccctggggaagtccgagttccagatctacaagaagtccggcatccaggaggtggaccggaccctggcgaaggaggggatcaagcgcggcgagacggaccaccacgccgtgtcccgggggagcgccaagctccgctggttcgtcgagcggaacatggtgaccccggagggcaaggtggtcgacctgggctgcgggcgcggcgggtggtcctactactgcggcgggctgaagaacgtgcgggaggtgaagggcctcaccaagggcgggcccggccacgaggagcccatccccatgagcacctacgggtggaacctggtccgcctgcagagcggcgtggacgtgttcttcacgccgcccgagaagtgcgacaccctcctgtgcgacatcggggagtccagccccaaccccaccatcgaggccggccggaccctgcgcgtcctcaacctggtggagaactggctgaacaacaacacccagttctgcatcaaggtgctcaacccgtacatgccctccgtcatcgagaagatggaggccctgcagcggcagtacggcggggcgctggtgcgcaaccccctcagccggaactccacgcacgagatgtactgggtgagcaacgccaccggcaacatcgtctccagcgtgaacatgatctcccgcatgctgatcaaccggttcaccatgaagcacaagaaggccacctacgagccggacgtggacctggggagcggcacgcgcaacatcgggatcgagaacgagatccccaacctggacatcatcggcaagcggatcgagaagatcaagcaggagcacgagatctcctggcactacgaccaggaccacccctacaagacctgggcctaccacggcagctacgagaccaagcagaccgggtccgccagctccatggtcaacggcgtggtgcgcctcctgacgaagccctgggacgtcgtgccgatggtgacccagatggcgatgaccgacaccacgcccttcgggcagcagcgcgtcttcaaggagaaggtggacacccggacccaggagcccaaggagggcaccaagaagctgatgaagatcacggccgagtggctctggaaggagctgggcaagaagaagacgccccgcatgtgcacccgggaggagttcaccaagaaggtgcgcagcaacgccgccctgggggccatcttcacggacgagaacaagtggaagtccgcgcgggaggccgtcgaggacggccgcttctgggagctcgtggaccgggagcgcaacctgcacctggaggggaagtgcgagacctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgggaacagcctgagcggcgtcgagggggagggcctccaccggctgggctacatcctgcgcgacgtggggaagaaggagggcggggccatgtacgccgacgacaccgccggctgggacacccggatcacgctcgaggacctgaagaacgaggagatggtcaccaaccacatgaagggggagcacaagaagctggcggaggccatcttcaagctcacctaccagaacaaggtggtgcgcgtccagcggccgacgccccgcggcacggtgatggacatcatctcccggcgcgaccagcggggcagcgggcaggtcggcacctacgggctgaacaccttcaccaacatggaggcccagctgatccgccagatggagggcgagggcatcttcaagtccatccagcacctcacggccaccgaggagatcgccgtccagaactggctggcgcgcgtggggcgggagcgcctgagccggatggccatctccggcgacgactgcgtggtcaagcccatcgacgaccgcttcgccagcgccctcaccgccctgaacgacatggggaaggtgcggaaggacatccagcagtgggagccctcccgcggctggaacgactggacccaggtgccgttctgcagccaccacttccacgagctggtcatgaaggacgggcgggtgctcgtggtcccctgccgcaaccaggacgagctgatcggccgggcgcgcatctcccagggcgccgggtggagcctgaaggagacggcctgcctcggcaagtcctacgcccagatgtggaccctgatgtacttccaccggcgcgacctgcggctcgccgcgaacgccatctgcagcgccgtgccctcccactgggtgcccaccagccgcaccacctggtccatccacgccaagcacgagtggatgacgaccgaggacatgctggcggtctggaaccgggtgtggatccaggagaacccgtggatggaggacaagacccccgtggagagctgggaggaggtcccctacctggggaagcgcgaggaccagtggtgcggctccctcatcgggctgaccagccgggccacgtgggccaagaacatccagaccgccatcaaccaggtgcgcagcctgatcggcaacgaggagtacaccgactacatgccctccatgaagcggttccgccgcgaggaggaggaggccggcgtgctctggtga

SEQ ID NO: 9219 - RNA, 9876 nt, synthetic construct
  misc_feature 1..9876: note = derived and/or modified CDS sequence (opt1) from DENV-2__FJ882593__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccaggagagcaactggatccagaaggagacgctggtgaccttcaagaacccccacgcgaagaagcaggacgtcgtggtcctcggctcccaggagggggccatgcacaccgccctgaccggcgccacggagatccagatgagcagcgggaacctcctcttcaccggccacctgaagtgccgcctgcggatggacaagctccagctgaagggcatgtcctacagcatgtgcaccgggaagttcaagatcgtgaaggagatcgccgagacccagcacggcacgatcgtgatccgcgtccagtacgagggggacggctccccctgcaagatccccttcgagatcaccgacctggagaagcggcacgtgctcggccgcctgatcaccgtgaacccgatcgtcaccgagaaggacagccccgtgaacatcgaggcggagccgcccttcggggactcctacatcatcatcggcgtggagccggggcagctgaagctcaactggttcaagaagggcagctccatcgggcagatgttcgagacgaccatgcgcggcgccaagcggatggccatcctgggcgacaccgcctgggacttcgggagcctgggcggggtcttcacctccatcggcaaggccctccaccaggtgttcggggcgatctacggcgccgccttcagcggcgtgtcctggacgatgaagatcctgatcggggtcatcatcacctggatcggcatgaacagccgctccaccagcctgtccgtgagcctggtgctcgtcggggtggtgaccctgtacctgggcgccgtcgtgcaggcggactccgggtgcgtggtcagctggaagaacaaggagctcaagtgcggctccggcatcttcatcacggacaacgtgcacacctggaccgagcagtacaagttccagcccgagagccccagcaagctggcctccgccatccagaaggcccacgaggaggggatctgcggcatccggagcgtgacccgcctggagaacctcatgtggaagcagatcacgcccgagctgaaccacatcctgtccgagaacgaggtcaagctcaccatcatgaccggggacatcaagggcatcatgcaggccgggaagcggagcctgcgcccgcagcccaccgagctgaagtactcctggaagacgtggggcaaggcgaagatgctcagcaccgagtcccacaaccagaccttcctgatcgacggccccgagaccgccgagtgcccgaacacgaaccgggcctggaacagcctggaggtggaggactacgggttcggcgtgttcaccaccaacatctggctcaagctgcgcgagaagcaggacgtcttctgcgactccaagctgatgagcgccgccatcaaggacaaccgggcggtgcacgccgacatggggtactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccggccccgtgtcccagcacaactaccgcccggggtaccacacgcagaccgcgggcccctggcacctcgggaagctggagatggacttcgacttctgcgagggcaccaccgtggtcgtgacggaggactgcgggaaccggggccccagcctgcgcaccaccaccgccagcggcaagctcatcacggagtggtgctgccggtcctgcaccctgcccccgctgcgctaccgcggggaggacggctgctggtacgggatggagatccgccccctcaaggagaaggaggagaacctggtgaacagcctggtcaccgccggccacgggcagatcgacaacttctccctcggcgtgctgggcatggccctgttcctcgaggagatgctgcggacccgcatcgggacgaagcacgcgatcctgctcgtggccgtcagcttcgtgaccctgatcaccggcaacatgtccttccgggacctggggcgcgtgatggtcatggtgggcgccaccatgacggacgacatcgggatgggcgtgacctacctcgccctgctggccgcgttcaaggtccgccccaccttcgccgccggcctcctgctgcggaagctcaccagcaaggagctgatgatggccacgatcgggatcgccctgctctcccagagcaccatccccgagaccatcctggagctgaccgacgcgctcgccctgggcatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaaggggctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacgggccccctcgtcgccggcgggctgctgaccgtgtgctacgtgctcaccgggcggagcgccgacctggagctggagcgcgccgccgacgtcaagtgggaggaccaggccgagatctccgggagctcccccatcctcagcatcaccatctccgaggacgggagcatgtccatcaagaacgaggaggaggagcagacgctgaccatcctgatccggaccggcctcctggtgatcagcggcgtgttcccggtctccatccccatcaccgcggccgcctggtacctgtgggaggtgaagaagcagcgcgccggggtgctctgggacgtccccagcccgccgcccgtggagaaggccgagctggaggacggcgcgtaccggatcaagcagcgcgggatcctgggctactcccagatcggggccggcgtgtacaaggagggcaccttccacacgatgtggcacgtcacccgcggggcggtgctcatgcaccggggcaagcggatcgagcccagctgggccgacgtgaagaaggacctgatctcctacgggggcgggtggaagctggagggcgagtggaaggagggcgaggaggtccaggtgctcgccctggagcccgggaagaacccccgcgcggtgcagaccaagcccggcatcttcaagaccaacacggggaccatcggcgccgtcagcctggacttctcccccgggaccagcggctcccccatcgtggaccggaagggcaaggtggtcgggctctacggcaacggggtggtgacccgcagcggcgcctacgtctccgccatcgcgcagacggagaagtccatcgaggacaaccccgagatcgaggacgacatcttccggaagaagcgcctgaccatcatggacctgcaccccggcgccgggaagaccaagcggtacctccccgccatcgtgcgcgaggccatcaagcggggcctgcgcaccctgatcctggccccgacgcgcgtggtcgcggccgagatggaggaggccctccgggggctgcccatccgctaccagacccccgccatcaagaccgagcacaccggccgggagatcgtggacctgatgtgccacgccacgttcaccatgcgcctcctgagccccgtgcgggtcccgaactacaacctgatcatcatggacgaggcgcacttcaccgaccccgcctccatcgccgcccgcgggtacatcagcacccgggtggagatgggcgaggccgcgggcatcttcatgacggccacgccgcccgggtcccgcgacccgttcccccagagcaacgcccccatcatggacgaggagcgggagatccccgagcgctcctggaacagcggccacgagtgggtgaccgacttcaaggggaagaccgtctggttcgtgccgtccatcaaggccggcaacgacatcgcggcctgcctccggaagaacgggaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggcgaggagcgggtgatcctcgcggggcccatgccggtcacccactccagcgccgcccagcgccggggccgcatcgggcgcaaccccaagaacgagaacgaccagtacatctacatgggcgagcccctggagaacgacgaggactgcgcccactggaaggaggccaagatgctgctcgacaacatcaacacccccgaggggatcatcccgtccatgttcgagcccgagcgggagaaggtggacgcgatcgacggcgagtaccgcctgcggggcgaggcccgcaagaccttcgtggacctgatgcggcgcggggacctccccgtctggctggcctacaaggtggccgccgagggcatcaactacgcggaccggaagtggtgcttcgacgggatcaagaacaaccagatcctggaggagaacatggaggtggagatctggacgaaggagggcgagcgcaagaagctcaagccgcggtggctggacgcccgcatctacagcgaccccctggccctcaaggagttcaaggagttcgccgcggggcggaagtccctgaccctgaacctcatcaccgagatgggccgcctgcccaccttcatgacgcagaaggcccggaacgccctggacaacctcgccgtcctgcacaccgccgaggcgggcgggcgcgcctacaaccacgccctgagcgagctccccgagaccctggagaccctgctcctgctgacgctcctggccaccgtgaccggcgggatcttcctgttcctcatgtccggcaagggcatcgggaagatgaccctgggcatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatggggttcctggagaagacgaagaaggacctgggcctcgggagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatgggcctgggcaaggggtggcccctgtccaagatggacatcggcgtgcccctcctggcgatcgggtgctacagccaggtgaacccgatcaccctgaccgccgccctcctgctgctcgtcgcccactacgccatcatcggccccgggctgcaggcgaaggccacccgcgaggcccagaagcgggccgccgcgggcatcatgaagaaccccacggtggacggcatcaccgtgatcgacctggagcccatcccgtacgaccccaagttcgagaagcagctcgggcaggtcatgctgctgatcctctgcgtgacccaggtgctgatgatgcgcaccacgtgggccctgtgcgaggccctcaccctggccaccggccccatctccaccctgtgggaggggaaccccggccggttctggaacacgaccatcgccgtcagcatggcgaacatcttccgcgggtcctacctcgccggcgccggcctgctgttcagcatcatgaagaacaccacctccacgcgccgggggaccggcaacatcggggagaccctcggcgagaagtggaagtcccgcctgaacgccctgggcaagtccgagttccagatctacaagaagtccgggatccaggaggtggaccggaccctcgcgaaggagggcatcaagcgcggggagacggaccaccacgccgtgtcccggggcagcgccaagctgcgctggttcgtcgagcggaacatggtgaccccggaggggaaggtggtcgacctgggctgcggccgcgggggctggtcctactactgcgggggcctcaagaacgtgcgggaggtgaaggggctgaccaagggcggccccgggcacgaggagcccatccccatgagcacctacggctggaacctggtccgcctccagagcggggtggacgtgttcttcacgccgcccgagaagtgcgacaccctgctgtgcgacatcggcgagtccagccccaaccccaccatcgaggccgggcggaccctccgcgtcctgaacctggtggagaactggctcaacaacaacacccagttctgcatcaaggtgctgaacccgtacatgccctccgtcatcgagaagatggaggccctgcagcggcagtacggcggcgcgctcgtgcgcaaccccctgagccggaactccacgcacgagatgtactgggtgagcaacgccaccgggaacatcgtctccagcgtgaacatgatctcccgcatgctgatcaaccggttcaccatgaagcacaagaaggccacctacgagccggacgtggacctgggcagcgggacgcgcaacatcggcatcgagtccgagatccccaacctcgacatcatcgggaagcggatcgagaagatcaagcaggagcacgagatcagctggcactacgaccaggaccacccctacaagacctgggcctaccacggctcctacgagaccaagcagaccggcagcgcctccagcatggtcaacggggtggtgcgcctgctgacgaagccctgggacgtcgtgccgatggtgacccagatggcgatgaccgacaccacgcccttcggccagcagcgcgtcttcaaggagaaggtggacacccggacccaggagcccaaggaggggaccaagaagctcatgaagatcacggccgagtggctgtggaaggagctgggcaagaagaagacgccccgcatgtgcacccgggaggagttcaccaagaaggtgcgctccaacgccgccctcggcgccatcttcacggacgagaacaagtggaagtccgcgcgggaggccgtcgaggacgggcgcttctgggagctggtggaccgggagcgcaacctgcacctcgagggcaagtgcgagacctgcgtgtacaacatgatggggaagcgggagaagaagctgggcgagttcgggaaggccaagggctcccgcgccatctggtacatgtggctgggcgcgcggttcctcgagttcgaggccctggggttcctgaacgaggaccactggttcagccgcggcaacagcctctccggggtcgagggcgaggggctgcaccggctgggctacatcctccgcgacgtgggcaagaaggagggcggggccatgtacgccgacgacaccgccgggtgggacacccggatcacgctggaggacctgaagaacgaggagatggtcaccaaccacatgaagggcgagcacaagaagctcgcggaggccatcttcaagctgacctaccagaacaaggtggtgcgcgtccagcggccgacgccccgcgggacggtgatggacatcatcagccggcgcgaccagcggggctccggccaggtggggacctacggcctgaacaccttcaccaacatggaggcccagctcatccgccagatggagggggagggcatcttcaagagcatccagcacctgacggccaccgaggagatcgccgtccagaactggctggcgcgcgtgggccgggagcgcctctcccggatggccatcagcggggacgactgcgtggtcaagcccatcgacgaccgcttcgcctccgccctgaccgccctgaacgacatgggcaaggtgcggaaggacatccagcagtgggagcccagccgcgggtggaacgactggacccaggtgccgttctgctcccaccacttccacgagctcgtcatgaaggacggccgggtgctggtggtcccctgccgcaaccaggacgagctgatcgggcgggcgcgcatcagccagggcgccggctggtccctcaaggagacggcctgcctgggcaagagctacgcccagatgtggaccctgatgtacttccaccggcgcgacctccggctggccgcgaacgccatctgctccgccgtgcccagccactgggtgcccacctcccgcaccacctggagcatccacgccaagcacgagtggatgacgaccgaggacatgctggcggtctggaaccgggtgtggatccaggagaacccgtggatggaggacaagacccccgtggagtcctgggaggaggtcccctacctcggcaagcgcgaggaccagtggtgcgggagcctgatcggcctgaccagccgggccacgtgggccaagaacatccagaccgccatcaaccaggtgcgctccctcatcgggaacgaggagtacaccgactacatgcccagcatgaagcggttccgccgcgaggaggaggaggccggcgtgctgtggtga

SEQ ID NO: 9220 - RNA, 9876 nt, synthetic construct
  misc_feature 1..9876: note = derived and/or modified CDS sequence (opt1) from DENV-2__FJ182014__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccttcctccgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctggagacccgcaccgagacctggatgagcagcgagggggcctggaagcacgtgcagcggatcgagacgtggatcctccgccacccgggcttcaccatcatggccgcgatcctggcctacaccatcgggaccacgcacttccagcgggccctgatcttcatcctcctgaccgccgtggcgcccagcatgaccatgcgctgcatcggcatcagcaaccgggacttcgtcgagggcgtgagcgggggcagctgggtggacatcgtcctggagcacgggagctgcgtgaccacgatggccaagaacaagcccaccctcgacttcgagctgatcaagaccgaggccaagcagcccgccaccctgcgcaagtactgcatcgaggccaagctcacgaacaccaccaccgagagccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctcgagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctggacttcaacgagatggtcctcctgcagatggaggacaaggcctggctggtgcaccggcagtggttcctcgacctgcccctgccctggctcccgggggccgacacccagggcagcaactggatccagaaggagacgctggtgaccttcaagaacccccacgcgaagaagcaggacgtcgtggtcctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctggggcgcctcatcaccgtgaacccgatcgtcaccgagaaggacagccccgtgaacatcgaggcggagccgcccttcggcgactcctacatcatcatcggggtggagccgggccagctgaagctgaactggttcaagaaggggagctccatcggccagatgttcgagacgaccatgcgcggcgccaagcggatggccatcctcggggacaccgcctgggacttcggcagcctcgggggcgtcttcacctccatcgggaaggccctgcaccaggtgttcggcgcgatctacggcgccgccttcagcggggtgtcctggacgatgaagatcctcatcggcgtcatcatcacctggatcgggatgaacagccgctccaccagcctgtccgtgagcctggtgctggtcggcgtggtgaccctctacctgggggccgtcgtgcaggcggactccggctgcgtggtcagctggaagaacaaggagctgaagtgcggctccgggatcttcatcacggacaacgtgcacacctggaccgagcagtacaagttccagcccgagagccccagcaagctcgcctccgccatccagaaggcccacgaggagggcatctgcgggatccggagcgtgacccgcctggagaacctgatgtggaagcagatcacgcccgagctcaaccacatcctgtccgagaacgaggtcaagctgaccatcatgaccggcgacatcaaggggatcatgcaggccggcaagcggagcctccgcccgcagcccaccgagctgaagtactcctggaagacgtggggcaaggcgaagatgctgagcaccgagtcccacaaccagaccttcctcatcgacgggcccgagaccgccgagtgcccgaacacgaaccgggcctggaacagcctggaggtggaggactacggcttcggggtgttcaccaccaacatctggctgaagctccgcgagaagcaggacgtcttctgcgactccaagctgatgagcgccgccatcaaggacaaccgggcggtgcacgccgacatgggctactggatcgagtccgccctgaacgacacctggaagatggagaaggccagcttcatcgaggtgaagtcctgccactggcccaagagccacaccctctggtccaacggcgtcctggagagcgagatgatcatccccaagaacttcgccgggcccgtgtcccagcacaactaccgcccgggctaccacacgcagaccgcggggccctggcacctgggcaagctcgagatggacttcgacttctgcgaggggaccaccgtggtcgtgacggaggactgcggcaaccggggccccagcctgcgcaccaccaccgccagcgggaagctgatcacggagtggtgctgccggtcctgcaccctgccgcccctgcgctaccggggcgaggacgggtgctggtacggcatggagatccgccccctgaaggagaaggaggagaacctcgtgaacagcctggtcaccgccgggcacggccagatcgacaacttctccctgggcgtgctcgggatggccctgttcctggaggagatgctccggacccgcatcggcacgaagcacgcgatcctgctggtggccgtcagcttcgtgaccctcatcaccgggaacatgtccttccgggacctgggccgcgtgatggtcatggtgggggccaccatgacggacgacatcggcatgggcgtgacctacctggccctcctggccgcgttcaaggtccgccccaccttcgccgccgggctgctcctgcggaagctgaccagcaaggagctcatgatggccacgatcggcatcgccctgctgtcccagagcaccatccccgagaccatcctcgagctgaccgacgcgctggccctcgggatgatggtgctgaagatcgtgcgcaacatggagaagtaccagctggccgtcacgatcatggccatctcctgcgtgcccaacgccgtgatcctccagaacgcgtggaaggtcagctgcaccatcctggccgccgtgtccgtcagccccctgctcctgacctccagccagcagaaggccgactggatccccctggcgctcaccatcaagggcctgaaccccacggccatcttcctgaccaccctctcccggaccagcaagaagcgctcctggccgctgaacgaggccatcatggccgtgggcatggtgagcatcctggcctccagcctcctgaagaacgacatccccatgacggggcccctggtcgcgggcgggctcctgaccgtgtgctacgtgctgaccggccggagcgccgacctcgagctggagcgcgccgccgacgtcaagtgggaggaccaggccgagatctccgggagctcccccatcctgagcatcatcatctccgaggacggcagcatgtccatcaagaacgaggaggaggagcagaccctcacgatcctgatccggaccggcctgctcgtgatcagcggggtgttcccggtctccatccccatcaccgcggccgcctggtacctgtgggaggtgaagaagcagcgcgccggcgtgctgtgggacgtcccctccccgccgcccgtggagaaggccgagctcgaggacggggcgtaccggatcaagcagcgcggcatcctggggtactcccagatcggcgccggcgtgtacaaggaggggaccttccacaccatgtggcacgtcacgcggggcgccgtgctgatgcaccgcgggaagcggatcgagcccagctgggccgacgtgaagaaggacctcatctcctacggcgggggctggaagctggagggcgagtggaaggagggggaggaggtccaggtgctggccctcgagcccggcaagaacccccgcgcggtgcagaccaagcccgggatcttcaagaccaacaccggcacgatcggggccgtcagcctggacttctcccccggcaccagcggctcccccatcgtggaccggaaggggaaggtggtcggcctgtacgggaacggcgtggtgacccgcagcggcgcctacgtctccgccatcgcgcagaccgagaagtccatcgaggacaaccccgagatcgaggacgacatcttccggaagaagcgcctcacgatcatggacctgcaccccggggccggcaagaccaagcggtacctgcccgccatcgtgcgcgaggccatcaagcgggggctccgcaccctgatcctggccccgacccgcgtggtcgcggccgagatggaggaggccctgcggggcctccccatccgctaccagacgcccgccatcaagaccgagcacaccgggcgggagatcgtggacctgatgtgccacgccaccttcacgatgcgcctgctcagccccgtgcgggtcccgaactacaacctgatcatcatggacgaggcgcacttcaccgaccccgcctccatcgccgcccgcggctacatcagcacccgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctgcggaagaacggcaagaaggtgatccagctcagccgcaagaccttcgactccgagtacgtcaagacgcgggccaacgactgggacttcgtggtgaccaccgacatcagcgagatgggcgccaacttcaaggccgagcgcgtcatcgacccccggcgctgcatgaagcccgtgatcctgaccgacggggaggagcgggtgatcctggcgggccccatgccggtcacgcactccagcgccgcccagcgccgggggcgcatcggccgcaaccccaagaacgagaacgaccagtacatctacatgggggagcccctcgagaacgacgaggactgcgcccactggaaggaggccaagatgctgctggacaacatcaacacccccgagggcatcatcccgtccatgttcgagcccgagcgggagaaggtggacgcgatcgacggcgagtaccgcctccgcggggaggcccgcaagaccttcgtggacctgatgcggcgcggcgacctgcccgtctggctcgcctacaaggtggccgccgaggggatcaactacgcggaccggaagtggtgcttcgacggcatcaagaacaaccagatcctggaggagaacatggaggtggagatctggaccaaggagggggagcgcaagaagctgaagccgcggtggctcgacgcccgcatctacagcgaccccctggccctgaaggagttcaaggagttcgccgcgggccggaagtccctcacgctgaacctgatcaccgagatgggccgcctccccaccttcatgacccagaaggcccggaacgccctggacaacctggccgtcctccacacggccgaggccgggggccgcgcctacaaccacgccctgagcgagctgcccgagaccctcgagaccctgctgctcctgaccctgctcgccacggtgaccgggggcatcttcctgttcctgatgtccggcaaggggatcggcaagatgaccctcgggatgtgctgcatcatcaccgccagcatcctgctgtggtacgcgcagatccagccgcactggatcgccgcctccatcatcctcgagttcttcctgatcgtcctgctcatccccgagcccgagaagcagcggacgccccaggacaaccagctgacgtacgtggtgatcgccatcctgaccgtcgtggccgcgaccatggccaacgagatgggcttcctcgagaagaccaagaaggacctggggctgggcagcatcacgacccaggagagcgagtccaacatcctcgacatcgacctgcgcccggccagcgcctggaccctgtacgccgtggcgaccacgttcgtcacccccatgctccggcactccatcgagaacagctccgtgaacgtgagcctgaccgccatcgccaaccaggccaccgtcctgatgggcctcgggaagggctggcccctgtccaagatggacatcggggtgcccctgctcgcgatcggctgctacagccaggtgaacccgatcacgctgaccgccgccctgctcctgctggtcgcccactacgccatcatcgggcccggcctccaggcgaaggccacccgcgaggcccagaagcgggccgccgcgggcatcatgaagaaccccaccgtggacgggatcacggtgatcgacctggagcccatcccgtacgaccccaagttcgagaagcagctgggccaggtcatgctcctgatcctgtgcgtgacccaggtgctcatgatgcgcaccacctgggccctgtgcgaggccctgacgctcgccaccgggcccatctccaccctgtgggagggcaaccccgggcggttctggaacaccacgatcgccgtcagcatggcgaacatcttccgcggctcctacctggccggcgccgggctcctgttcagcatcatgaagaacaccacctccacccgccggggcacggggaacatcggcgagaccctgggcgagaagtggaagtcccgcctcaacgccctggggaagtccgagttccagatctacaagaagtccggcatccaggaggtggaccggaccctggcgaaggaggggatcaagcgcggcgagaccgaccaccacgccgtgtcccgggggagcgccaagctccgctggttcgtcgagcggaacatggtgacgccggagggcaaggtggtcgacctgggctgcgggcgcggcgggtggtcctactactgcggcgggctgaagaacgtgcgggaggtgaagggcctcaccaagggcgggcccggccacgaggagcccatccccatgagcacctacgggtggaacctggtccgcctgcagagcggcgtggacgtgttcttcaccccgcccgagaagtgcgacacgctcctgtgcgacatcggggagtccagccccaaccccaccatcgaggccggccggaccctgcgcgtcctcaacctggtggagaactggctgaacaacaacacccagttctgcatcaaggtgctcaacccgtacatgccctccgtcatcgagaagatggaggccctgcagcggcagtacggcggggcgctggtgcgcaaccccctcagccggaactccacccacgagatgtactgggtgagcaacgccacgggcaacatcgtctccagcgtgaacatgatctcccgcatgctgatcaaccggttcaccatgaagcacaagaaggccacctacgagccggacgtggacctggggagcggcacccgcaacatcgggatcgagtccgagatccccaacctggacatcatcggcaagcggatcgagaagatcaagcaggagcacgagatcagctggcactacgaccaggaccacccctacaagacgtgggcctaccacggctcctacgagaccaagcagaccgggagcgcctccagcatggtcaacggcgtggtgcgcctcctgaccaagccctgggacgtcgtgccgatggtgacgcagatggcgatgaccgacaccacccccttcgggcagcagcgcgtcttcaaggagaaggtggacacgcggacccaggagcccaaggagggcaccaagaagctgatgaagatcaccgccgagtggctctggaaggagctgggcaagaagaagacgccccgcatgtgcacccgggaggagttcaccaagaaggtgcgctccaacgccgccctgggggccatcttcaccgacgagaacaagtggaagtccgcgcgggaggccgtcgaggacggccgcttctgggagctcgtggaccgggagcgcaacctgcacctggaggggaagtgcgagacgtgcgtgtacaacatgatgggcaagcgggagaagaagctcggggagttcggcaaggccaagggctcccgcgccatctggtacatgtggctgggggcgcggttcctggagttcgaggccctcggcttcctgaacgaggaccactggttcagccgcgggaacagcctgtccggcgtcgagggggagggcctccaccggctgggctacatcctgcgcgacgtggggaagaaggagggcggggccatgtacgccgacgacaccgccggctgggacacccggatcaccctcgaggacctgaagaacgaggagatggtcacgaaccacatgaagggggagcacaagaagctggcggaggccatcttcaagctcacctaccagaacaaggtggtgcgcgtccagcggccgacgccccgcggcaccgtgatggacatcatcagccggcgcgaccagcggggctccgggcaggtcggcacctacgggctgaacaccttcaccaacatggaggcccagctgatccgccagatggagggcgagggcatcttcaagagcatccagcacctcaccgccacggaggagatcgccgtccagaactggctggcgcgcgtggggcgggagcgcctgtcccggatggccatcagcggcgacgactgcgtggtcaagcccatcgacgaccgcttcgcctccgccctcaccgccctgaacgacatggggaaggtgcggaaggacatccagcagtgggagcccagccgcggctggaacgactggacccaggtgccgttctgctcccaccacttccacgagctggtcatgaaggacgggcgggtgctcgtggtcccctgccgcaaccaggacgagctgatcggccgggcgcgcatcagccagggcgccgggtggtccctgaaggagaccgcctgcctcggcaagagctacgcccagatgtggacgctgatgtacttccaccggcgcgacctgcggctcgccgcgaacgccatctgctccgccgtgcccagccactgggtgcccacctcccgcaccacctggagcatccacgccaagcacgagtggatgaccacggaggacatgctggcggtctggaaccgggtgtggatccaggagaacccgtggatggaggacaagacccccgtggagtcctgggaggaggtcccctacctggggaagcgcgaggaccagtggtgcggcagcctcatcgggctgaccagccgggccacctgggccaagaacatccagacggccatcaaccaggtgcgctccctgatcggcaacgaggagtacaccgactacatgcccagcatgaagcggttccgccgcgaggaggaggaggccggcgtgctctggtga

SEQ ID NO: 9221 - RNA, 9876 nt, synthetic construct
  misc_feature 1..9876: note = derived and/or modified CDS sequence (opt1) from DENV-2__FJ547090__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagagccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccaccatcaaggacaaccgggccgtgcacgcggacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcctcggctaccacacccagaccgccgggccgtggcacctgggcaagctggagatggacttcgacttctgcgaggggaccacggtggtcgtgaccgaggactgcggcaaccggggccccagcctccgcaccaccacggcgagcgggaagctgatcaccgagtggtgctgccggtcctgcaccctgccgcccctgcgctaccggggcgaggacgggtgctggtacggcatggagatccgcccgctgaaggagaaggaggagaacctggtgaacagcctcgtcaccgccgggcacggccagatcgacaacttctccctgggcgtgctggggatggccctcttcctggaggagatgctgcggacgcgcatcggcaccaagcacgccatcctcctggtggcggtcagcttcgtgaccctgatcaccgggaacatgtccttccgggacctcggccgcgtgatggtcatggtgggggccacgatgaccgacgacatcggcatgggcgtgacctacctggccctgctcgccgccttcaaggtccgccccaccttcgcggccgggctgctgctccggaagctgacgagcaaggagctgatgatggccaccatcggcatcgccctcctgtcccagagcaccatccccgagaccatcctggagctcacggacgccctggcgctggggatgatggtgctcaagatcgtgcgcaacatggagaagtaccagctggccgtcaccatcatggccatctcctgcgtgcccaacgccgtgatcctgcagaacgcctggaaggtcagctgcaccatcctcgcggccgtgtccgtcagcccgctgctgctcacctccagccagcagaaggccgactggatccccctggccctgacgatcaagggcctcaaccccaccgcgatcttcctgaccaccctgtcccggacgagcaagaagcgctcctggcccctcaacgaggccatcatggccgtgggcatggtgagcatcctggcctccagcctgctcaagaacgacatcccgatgaccgggcccctggtcgccggcgggctgctcaccgtgtgctacgtgctgaccggccggagcgcggacctggagctcgagcgcgccgccgacgtcaagtgggaggaccaggccgagatctccgggagctcccccatcctgagcatcacgatctccgaggacggcagcatgtccatcaagaacgaggaggaggagcagaccctgaccatcctcatccggaccggcctgctggtgatcagcggggtgttccccgtctccatcccgatcaccgccgcggcctggtacctctgggaggtgaagaagcagcgcgccggcgtgctgtgggacgtcccctccccgccgcccgtggagaaggccgagctggaggacggggcctaccggatcaagcagcgcggcatcctcgggtactcccagatcggcgcgggcgtgtacaaggaggggacgttccacaccatgtggcacgtcacccggggcgccgtgctgatgcaccgcgggaagcggatcgagcccagctgggccgacgtgaagaaggacctgatctcctacggcgggggctggaagctcgagggcgagtggaaggagggggaggaggtccaggtgctggccctggagcccggcaagaacccccgcgccgtgcagaccaagcccgggatcttcaagacgaacaccggcaccatcggggcggtcagcctcgacttctcccccggcaccagcggctcccccatcgtggaccggaaggggaaggtggtcggcctgtacgggaacggcgtggtgacgcgcagcggcgcctacgtctccgccatcgcccagaccgagaagtccatcgaggacaacccggagatcgaggacgacatcttccggaagaagcgcctgaccatcatggacctccaccccggggcgggcaagaccaagcggtacctgcccgccatcgtgcgcgaggccatcaagcgggggctgcgcacgctgatcctcgcccccacccgcgtggtcgccgcggagatggaggaggccctgcggggcctgccgatccgctaccagacccccgccatcaagaccgagcacacggggcgggagatcgtggacctcatgtgccacgccaccttcaccatgcgcctgctgagccccgtgcgggtccccaactacaacctcatcatcatggacgaggcccacttcaccgacccggcgtccatcgccgcccgcggctacatcagcacgcgggtggagatgggcgaggccgccgggatcttcatgaccgcgacgccgcccggctcccgcgaccccttcccgcagagcaacgcccccatcatggacgaggagcgggagatccccgagcgctcctggaacagcgggcacgagtgggtgaccgacttcaagggcaagacggtctggttcgtgccctccatcaaggccgggaacgacatcgccgcgtgcctgcggaagaacggcaagaaggtgatccagctgagccgcaagaccttcgactccgagtacgtcaagacccgggccaacgactgggacttcgtggtgaccacggacatcagcgagatgggcgccaacttcaaggccgagcgcgtcatcgacccgcggcgctgcatgaagcccgtgatcctcaccgacggggaggagcgggtgatcctggccggccccatgcccgtcacccactccagcgcggcccagcgccgggggcgcatcggccgcaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgggagaaggtggacgccatcgacggcgagtaccgcctgcgcggggaggcgcgcaagacgttcgtggacctcatgcggcgcggcgacctgcccgtctggctggcctacaaggtggccgccgaggggatcaactacgccgaccggaagtggtgcttcgacggcatcaagaacaaccagatcctcgaggagaacatggaggtggagatctggaccaaggagggggagcgcaagaagctgaagccccggtggctggacgcgcgcatctacagcgacccgctcgccctgaaggagttcaaggagttcgccgccggccggaagtccctgaccctcaacctgatcaccgagatgggccgcctgcccacgttcatgacccagaaggcgcggaacgccctcgacaacctggccgtcctgcacaccgccgaggccgggggccgcgcgtacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggccagcatcctcctgtggtacgcccagatccagccccactggatcgcggcctccatcatcctggagttcttcctcatcgtcctgctgatcccggagcccgagaagcagcggacgccccaggacaaccagctcacctacgtggtgatcgccatcctgaccgtcgtggccgccacgatggcgaacgagatgggcttcctggagaagaccaagaaggacctcgggctgggcagcatcaccacccaggagagcgagtccaacatcctggacatcgacctccgccccgccagcgcctggacgctgtacgccgtggccaccaccttcgtcaccccgatgctgcggcactccatcgagaacagctccgtgaacgtgagcctcacggcgatcgccaaccaggccaccgtcctgatgggcctggggaagggctggcccctctccaagatggacatcggggtgcccctgctggccatcggctgctacagccaggtgaaccccatcaccctcaccgcggccctgctgctcctggtcgcccactacgccatcatcgggccgggcctgcaggccaaggcgacgcgcgaggcccagaagcgggccgccgccggcatcatgaagaaccccaccgtggacgggatcaccgtgatcgacctcgagcccatcccctacgacccgaagttcgagaagcagctgggccaggtcatgctgctcatcctgtgcgtgacccaggtgctgatgatgcgcacgacctgggcgctctgcgaggccctgaccctggccaccgggcccatctccacgctctgggagggcaaccccgggcggttctggaacaccaccatcgccgtcagcatggccaacatcttccgcggctcctacctggcgggcgccgggctcctcttcagcatcatgaagaacaccacgtccacccgccggggcaccgggaacatcggcgagaccctgggcgagaagtggaagtcccgcctgaacgccctcgggaagtccgagttccagatctacaagaagtccggcatccaggaggtggaccggacgctggccaaggaggggatcaagcgcggcgagaccgaccaccacgcggtgtcccgggggagcgccaagctgcgctggttcgtcgagcggaacatggtgacccccgagggcaaggtggtcgacctcggctgcgggcgcggcgggtggtcctactactgcggcgggctgaagaacgtgcgggaggtgaagggcctgaccaagggcgggccgggccacgaggagcccatccccatgagcacgtacgggtggaacctcgtccgcctgcagagcggcgtggacgtgttcttcacgccgcccgagaagtgcgacaccctgctctgcgacatcggggagtccagccccaaccccaccatcgaggccggccggaccctgcgcgtcctgaacctcgtggagaactggctgaacaacaacacgcagttctgcatcaaggtgctgaacccctacatgccctccgtcatcgagaagatggaggccctccagcggcagtacggcggggccctggtgcgcaaccccctgagccggaactccacccacgagatgtactgggtgagcaacgcgaccggcaacatcgtctccagcgtgaacatgatctcccgcatgctgatcaaccggttcaccatgaagcacaagaaggccacgtacgagcccgacgtggacctcgggagcggcacccgcaacatcgggatcgagtccgagatcccgaacctggacatcatcggcaagcggatcgagaagatcaagcaggagcacgagatcagctggcactacgaccaggaccacccctacaagacctgggcctaccacggctcctacgagaccaagcagacggggagcgcctccagcatggtcaacggcgtggtgcgcctgctcaccaagccctgggacgtcgtgcccatggtgacccagatggccatgaccgacacgaccccgttcgggcagcagcgcgtcttcaaggagaaggtggacacccggacccaggagcccaaggagggcacgaagaagctgatgaagatcaccgcggagtggctgtggaaggagctcggcaagaagaagacgccccgcatgtgcacccgggaggagttcacgaagaaggtgcgctccaacgccgccctgggggccatcttcaccgacgagaacaagtggaagtccgcccgggaggcggtcgaggacggccgcttctgggagctggtggaccgggagcgcaacctccacctggaggggaagtgcgagacctgcgtgtacaacatgatgggcaagcgggagaagaagctgggggagttcggcaaggccaagggctcccgcgccatctggtacatgtggctcggggcccggttcctggagttcgaggcgctgggcttcctcaacgaggaccactggttcagccgcgggaacagcctgtccggcgtcgagggggagggcctgcaccggctcggctacatcctgcgcgacgtggggaagaaggagggcggggccatgtacgccgacgacaccgccggctgggacacgcggatcaccctggaggacctcaagaacgaggagatggtcaccaaccacatgaagggggagcacaagaagctggccgaggcgatcttcaagctgacctaccagaacaaggtggtgcgcgtccagcggcccacgccgcgcggcaccgtgatggacatcatcagccggcgcgaccagcggggctccgggcaggtcggcacctacgggctcaacaccttcacgaacatggaggcccagctgatccgccagatggagggcgagggcatcttcaagagcatccagcacctgaccgccaccgaggagatcgccgtccagaactggctcgcccgcgtggggcgggagcgcctgtcccggatggcgatcagcggcgacgactgcgtggtcaagcccatcgacgaccgcttcgcctccgccctgaccgccctcaacgacatggggaaggtgcggaaggacatccagcagtgggagcccagccgcggctggaacgactggacccaggtgcccttctgctcccaccacttccacgagctggtcatgaaggacgggcgggtgctggtggtcccgtgccgcaaccaggacgagctcatcggccgggcccgcatcagccagggcgcggggtggtccctgaaggagaccgcctgcctgggcaagagctacgcccagatgtggaccctcatgtacttccaccggcgcgacctgcggctggccgccaacgcgatctgctccgccgtgcccagccactgggtgcccacctcccgcaccacgtggagcatccacgccaagcacgagtggatgaccaccgaggacatgctcgccgtctggaaccgggtgtggatccaggagaacccctggatggaggacaagaccccggtggagtcctgggaggaggtcccctacctggggaagcgcgaggaccagtggtgcggcagcctgatcgggctcacgagccgggcgacctgggccaagaacatccagaccgccatcaaccaggtgcgctccctgatcggcaacgaggagtacaccgactacatgcccagcatgaagcggttccgccgcgaggaggaggaggccggcgtgctgtggtga

SEQ ID NO: 9222 - RNA, 9876 nt, synthetic construct
  misc_feature 1..9876: note = derived and/or modified CDS sequence (opt1) from DENV-2__EU482630__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccttcctccgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctggagacccgcaccgagacctggatgagcagcgagggggcctggaagcacgtgcagcggatcgagacgtggatcctccgccacccgggcttcaccatcatggccgcgatcctggcctacaccatcgggaccacgcacttccagcgggccctgatcttcatcctcctgaccgccgtggcgcccagcatgaccatgcgctgcatcggcatcagcaaccgggacttcgtcgagggcgtgagcgggggcagctgggtggacatcgtcctggagcacgggagctgcgtgaccacgatggccaagaacaagcccaccctcgacttcgagctgatcaagaccgaggccaagcagcccgccaccctgcgcaagtactgcatcgaggccaagctcacgaacaccaccaccgagagccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctcgagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctggacttcaacgagatggtcctcctgcagatggaggacaaggcctggctggtgcaccggcagtggttcctcgacctgcccctgccctggctcccgggggccgacacccagggcagcaactggatccagaaggagacgctggtgaccttcaagaacccccacgcgaagaagcaggacgtcgtggtcctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctggggcgcctcatcaccgtgaacccgatcgtcaccgagaaggacagccccgtgaacatcgaggcggagccgcccttcggcgactcctacatcatcatcggggtggagccgggccagctgaagctgaactggttcaagaaggggagctccatcggccagatgttcgagacgaccatgcgcggcgccaagcggatggccatcctcggggacaccgcctgggacttcggcagcctcgggggcgtcttcacctccatcgggaaggccctgcaccaggtgttcggcgcgatctacggcgccgccttcagcggggtgtcctggacgatgaagatcctcatcggcgtcatcatcacctggatcgggatgaacagccgctccaccagcctgtccgtgagcctggtgctggtcggcgtggtgaccctctacctgggggccgtcgtgcaggcggactccggctgcgtggtcagctggaagaacaaggagctgaagtgcggctccgggatcttcatcacggacaacgtgcacacctggaccgagcagtacaagttccagcccgagagccccagcaagctcgcctccgccatccagaaggcccacgaggagggcatctgcgggatccggagcgtgacccgcctggagaacctgatgtggaagcagatcacgcccgagctcaaccacatcctgtccgagaacgaggtcaagctgaccatcatgaccggcgacatcaaggggatcatgcaggccggcaagcggagcctccgcccgcagcccaccgagctgaagtactcctggaagacgtggggcaaggcgaagatgctgagcaccgagtcccacaaccagaccttcctcatcgacgggcccgagaccgccgagtgcccgaacacgaaccgggcctggaacagcctggaggtggaggactacggcttcggggtgttcaccaccaacatctggctgaagctccgcgagaagcaggacgtcttctgcgactccaagctgatgagcgccgccatcaaggacaaccgggcggtgcacgccgacatgggctactggatcgagtccgccctgaacgacacctggaagatggagaaggccagcttcatcgaggtgaagtcctgccactggcccaagagccacaccctctggtccaacggcgtcctggagagcgagatgatcatccccaagaacttcgccgggcccgtgtcccagcacaactaccgcccgggctaccacacgcagaccgcggggccctggcacctgggcaagctcgagatggacttcgacttctgcgaggggaccaccgtggtcgtgacggaggactgcggcaaccggggccccagcctgcgcaccaccaccgccagcgggaagctgatcacggagtggtgctgccggtcctgcaccctgccgcccctgcgctaccggggcgaggacgggtgctggtacggcatggagatccgccccctgaaggagaaggaggagaacctcgtgaacagcctggtcaccgccgggcacggccagatcgacaacttctccctgggcgtgctcgggatggccctgttcctggaggagatgctccggacccgcatcggcacgaagcacgcgatcctgctggtggccgtcagcttcgtgaccctcatcaccgggaacatgtccttccgggacctgggccgcgtgatggtcatggtgggggccaccatgacggacgacatcggcatgggcgtgacctacctggccctcctggccgcgttcaaggtccgccccaccttcgccgccgggctgctcctgcggaagctgaccagcaaggagctcatgatggccacgatcggcatcgccctgctgtcccagagcaccatccccgagaccatcctcgagctgaccgacgcgctggccctcgggatgatggtgctgaagatcgtgcgcaacatggagaagtaccagctggccgtcacgatcatggccatctcctgcgtgcccaacgccgtgatcctccagaacgcgtggaaggtcagctgcaccatcctggccgccgtgtccgtcagccccctgctcctgacctccagccagcagaaggccgactggatccccctggcgctcaccatcaagggcctgaaccccacggccatcttcctgaccaccctctcccggaccagcaagaagcgctcctggccgctgaacgaggccatcatggccgtgggcatggtgagcatcctggcctccagcctcctgaagaacgacatccccatgacggggcccctggtcgcgggcgggctcctgaccgtgtgctacgtgctgaccggccggagcgccgacctcgagctggagcgcgccgccgacgtcaagtgggaggaccaggccgagatctccgggagctcccccatcctgagcatcaccatctccgaggacggcagcatgtccatcaagaacgaggaggaggagcagacgctcaccatcctgatccggaccggcctgctcgtgatcagcggggtgttcccggtctccatccccatcaccgcggccgcctggtacctgtgggaggtgaagaagcagcgcgccggcgtgctgtgggacgtcccctccccgccgcccgtggagaaggccgagctcgaggacggggcgtaccggatcaagcagcgcggcatcctggggtactcccagatcggcgccggcgtgtacaaggaggggaccttccacacgatgtggcacgtcacccggggcgccgtgctgatgcaccgcgggaagcggatcgagcccagctgggccgacgtgaagaaggacctcatctcctacggcgggggctggaagctggagggcgagtggaaggagggggaggaggtccaggtgctggccctcgagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctgtacgggaacggcgtggtgacccgcagcggcgcctacgtctccgccatcgcgcagacggagaagtccatcgaggacaaccccgagatcgaggacgacatcttccggaagaagcgcctcaccatcatggacctgcaccccggggccggcaagaccaagcggtacctgcccgccatcgtgcgcgaggccatcaagcgggggctccgcaccctgatcctggccccgacgcgcgtggtcgcggccgagatggaggaggccctgcggggcctccccatccgctaccagacccccgccatcaagaccgagcacaccgggcgggagatcgtggacctgatgtgccacgccacgttcaccatgcgcctgctcagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctgcggaagaacggcaagaaggtgatccagctcagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctggcgggccccatgccggtcacccactccagcgccgcccagcgccgggggcgcatcggccgcaaccccaagaacgagaacgaccagtacatctacatgggggagcccctcgagaacgacgaggactgcgcccactggaaggaggccaagatgctgctggacaacatcaacacccccgagggcatcatcccgtccatgttcgagcccgagcgggagaaggtggacgcgatcgacggcgagtaccgcctccgcggggaggcccgcaagaccttcgtggacctgatgcggcgcggcgacctgcccgtctggctcgcctacaaggtggccgccgaggggatcaactacgcggaccggaagtggtgcttcgacggcatcaagaacaaccagatcctggaggagaacatggaggtggagatctggacgaaggagggggagcgcaagaagctgaagccgcggtggctcgacgcccgcatctacagcgaccccctggccctgaaggagttcaaggagttcgccgcgggccggaagtccctcaccctgaacctgatcaccgagatgggccgcctccccaccttcatgacgcagaaggcccggaacgccctggacaacctggccgtcctccacaccgccgaggccgggggccgcgcctacaaccacgccctgagcgagctgcccgagaccctcgagaccctgctgctcctgacgctgctcgccaccgtgaccgggggcatcttcctgttcctgatgtccggcaaggggatcggcaagatgaccctcgggatgtgctgcatcatcaccgccagcatcctgctgtggtacgcgcagatccagccgcactggatcgccgcctccatcatcctcgagttcttcctgatcgtcctgctcatccccgagcccgagaagcagcggacgccccaggacaaccagctgacctacgtggtgatcgccatcctgaccgtcgtggccgcgaccatggccaacgagatgggcttcctcgagaagacgaagaaggacctggggctgggcagcatcaccacccaggagagcgagtccaacatcctcgacatcgacctgcgcccggccagcgcctggaccctgtacgccgtggcgacgaccttcgtcacccccatgctccggcactccatcgagaacagctccgtgaacgtgagcctgaccgccatcgccaaccaggccacggtcctgatgggcctcgggaagggctggcccctgtccaagatggacatcggggtgcccctgctcgcgatcggctgctacagccaggtgaacccgatcaccctgaccgccgccctgctcctgctggtcgcccactacgccatcatcgggcccggcctccaggcgaaggccacccgcgaggcccagaagcgggccgccgcgggcatcatgaagaaccccacggtggacgggatcaccgtgatcgacctggagcccatcccgtacgaccccaagttcgagaagcagctgggccaggtcatgctcctgatcctgtgcgtgacccaggtgctcatgatgcgcaccacgtgggccctgtgcgaggccctgaccctcgccaccgggcccatctccaccctgtgggagggcaaccccgggcggttctggaacacgaccatcgccgtcagcatggcgaacatcttccgcggctcctacctggccggcgccgggctcctgttcagcatcatgaagaacaccacctccacgcgccggggcaccgggaacatcggcgagaccctgggcgagaagtggaagtcccgcctcaacgccctggggaagtccgagttccagatctacaagaagtccggcatccaggaggtggaccggaccctggcgaaggaggggatcaagcgcggcgagacggaccaccacgccgtgtcccgggggagcgccaagctccgctggttcgtcgagcggaacatggtgaccccggagggcaaggtggtcgacctgggctgcgggcgcggcgggtggtcctactactgcggcgggctgaagaacgtgcgggaggtgaagggcctcaccaagggcgggcccggccacgaggagcccatccccatgagcacctacgggtggaacctggtccgcctgcagagcggcgtggacgtgttcttcacgccgcccgagaagtgcgacaccctcctgtgcgacatcggggagtccagccccaaccccaccatcgaggccggccggaccctgcgcgtcctcaacctggtggagaactggctgaacaacaacacccagttctgcatcaaggtgctcaacccgtacatgccctccgtcatcgagaagatggaggccctgcagcggcagtacggcggggcgctggtgcgcaaccccctcagccggaactccacgcacgagatgtactgggtgagcaacgccaccggcaacatcgtctccagcgtgaacatgatctcccgcatgctgatcaaccggttcaccatgaagcacaagaaggccacctacgagccggacgtggacctggggagcggcacgcgcaacatcgggatcgagtccgagatccccaacctggacatcatcggcaagcggatcgagaagatcaagcaggagcacgagatcagctggcactacgaccaggaccacccctacaagacctgggcctaccacggctcctacgagaccaagcagaccgggagcgcctccagcatggtcaacggcgtggtgcgcctcctgacgaagccctgggacgtcgtgccgatggtgacccagatggcgatgaccgacaccacgcccttcgggcagcagcgcgtcttcaaggagaaggtggacacccggacccaggagcccaaggagggcaccaagaagctgatgaagatcacggccgagtggctctggaaggagctgggcaagaagaagacgccccgcatgtgcacccgggaggagttcaccaagaaggtgcgctccaacgccgccctgggggccatcttcacggacgagaacaagtggaagtccgcgcgggaggccgtcgaggacggccgcttctgggagctcgtggaccgggagcgcaacctgcacctggaggggaagtgcgagacctgcgtgtacaacatgatgggcaagcgggagaagaagctcggggagttcggcaaggccaagggctcccgcgccatctggtacatgtggctgggggcgcggttcctggagttcgaggccctcggcttcctgaacgaggaccactggttcagccgcgggaacagcctgtccggcgtcgagggggagggcctccaccggctgggctacatcctgcgcgacgtggggaagaaggagggcggggccatgtacgccgacgacaccgccggctgggacacccggatcacgctcgaggacctgaagaacgaggagatggtcaccaaccacatgaagggggagcacaagaagctggcggaggccatcttcaagctcacctaccagaacaaggtggtgcgcgtccagcggccgacgccccgcggcaccgtgatggacatcatcagccggcgcgaccagcggggctccgggcaggtcggcacctacgggctgaacaccttcaccaacatggaggcccagctgatccgccagatggagggcgagggcatcttcaagagcatccagcacctcacggccaccgaggagatcgccgtccagaactggctggcgcgcgtggggcgggagcgcctgtcccggatggccatcagcggcgacgactgcgtggtcaagcccatcgacgaccgcttcgcctccgccctcaccgccctgaacgacatggggaaggtgcggaaggacatccagcagtgggagcccagccgcggctggaacgactggacccaggtgccgttctgctcccaccacttccacgagctggtcatgaaggacgggcgggtgctcgtggtcccctgccgcaaccaggacgagctgatcggccgggcgcgcatcagccagggcgccgggtggtccctgaaggagacggcctgcctcggcaagagctacgcccagatgtggaccctgatgtacttccaccggcgcgacctgcggctcgccgcgaacgccatctgctccgccgtgcccagccactgggtgcccacctcccgcaccacctggagcatccacgccaagcacgagtggatgacgaccgaggacatgctggcggtctggaaccgggtgtggatccaggagaacccgtggatggaggacaagacccccgtggagtcctgggaggaggtcccctacctggggaagcgcgaggaccagtggtgcggcagcctcatcgggctgaccagccgggccacgtgggccaagaacatccagaccgccatcaaccaggtgcgctccctgatcggcaacgaggagtacaccgactacatgcccagcatgaagcggttccgccgcgaggaggaggaggccggcgtgctctggtga

SEQ ID NO: 9223 - RNA, 9876 nt, synthetic construct
  misc_feature 1..9876: note = derived and/or modified CDS sequence (opt1) from DENV-2__FJ882594__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaacatcctggagctcaccgacgcgctggccctggggatgatggtcctcaagatcgtgcggaacatggagaagtaccagctggccgtgaccatcatggccatctcctgcgtcccgaacgccgtgatcctgcagaacgcgtggaaggtgagctgcacgatcctcgccgccgtctccgtgagccccctgctgctcacctccagccagcagaaggccgactggatccccctggcgctgaccatcaagggcctcaaccccaccgccatcttcctgacgaccctgtcccgcaccagcaagaagcggtcctggccgctcaacgaggccatcatggccgtcggcatggtgagcatcctggcctccagcctgctcaagaacgacatccccatgaccgggcccctggtggcgggcgggctgctcacggtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagaccctgacgatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacaccatgtggcacgtgacgcgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacaccggcacgatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagaccgagaagtccatcgaggacaaccccgagatcgaggacgacatcttccgcaagaagcggctgacgatcatggacctccaccccggggccggcaagaccaagcgctacctgcccgccatcgtccgggaggccatcaagcgcgggctgcgcaccctgatcctcgccccgacccgggtggtggcggccgagatggaggaggccctgcgcggcctgcccatccggtaccagacgaccgccatcaagaccgagcacaccgggcgcgagatcgtcgacctcatgtgccacgccacgttcaccatgcggctgctgagccccgtgcgcgtgcccaactacaacctcatcatcatggacgaggcgcacttcaccgacccggcctccatcgccgcccggggctacatcagcacccgcgtcgagatgggcgaggccgcggggatcttcatgacggccacgccgcccggctcccgggaccccttcccgcagagcaacgcccccatcatggacgaggagcgcgagatccccgagcggtcctggaacagcgggcacgagtgggtgaccgacttcaagggcaagaccgtgtggttcgtcccctccatcaaggccgggaacgacatcgcggcctgcctgcgcaagaacggcaagaaggtgatccagctgagccggaagacgttcgactccgagtacgtgaagacccgcgccaacgactgggacttcgtcgtgaccaccgacatcagcgagatgggcgccaacttcaaggccgagcgggtgatcgacccgcgccggtgcatgaagcccgtcatcctcacggacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagaccttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggacgaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccaccttcatgacgcagaaggcccgcaacgccctcgacaacctggccgtgctgcacaccgccgaggccgggggccgggcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccggcccgccagcgcctggaccctgtacgccgtggcgacgaccttcgtgaccccgatgctgcgccactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacccgggaggcccagaagcgcgccgccgcgggcatcatgaagaaccccacggtcgacgggatcaccgtgatcgacctcgagcccatcccctacgacccgaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaaccccgggcgcttctggaacacgaccatcgccgtgagcatggcgaacatcttccgcggctcctacctggccggcgccgggctcctgttcagcatcatgaagaacaccaccaacacgcggcgcggcaccgggaacatcggcgagaccctgggcgagaagtggaagtcccggctgaacgccctcggcaagagcgagttccagatctacaagaagtccggcatccaggaggtcgaccgcaccctggcgaaggaggggatcaagcggggcgagacggaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacctacgggtggaacctcgtgcggctgcagagcggcgtcgacgtgttcttcacgcccccggagaagtgcgacaccctgctctgcgacatcggggagagctcccccaaccccaccatcgaggccggccgcaccctgcgggtgctgaacctcgtcgagaactggctgaacaacaacacccagttctgcatcaaggtgctgaacccctacatgccgagcgtgatcgagaagatggaggccctccagcgcaagtacggcggggcgctggtccggaaccccctgtcccgcaacagcacgcacgagatgtactgggtgtccaacgccaccggcaacatcgtgagctccgtcaacatgatcagccggatgctgatcaaccgcttcaccatgaagcacaagaaggccacctacgagcccgacgtggacctcgggtccggcacgcggaacatcgggatcgagagcgagatcccgaacctggacatcatcggcaagcgcatcgagaagatcaagcaggagcacgaggcctcctggcactacgaccaggaccacccctacaagacctgggcctaccacggcagctacgagaccaagcagaccgggtccgcgagctccatggtgaacggcgtcgtgcgcctgctcacgaagccctgggacgtggtccccatggtgacccagatggccatgaccgacaccacgccgttcgggcagcagcgggtgttcaaggagaaggtcgacacccgcacccaggagcccaaggagggcaccaagaagctgatgaagatcacggccgagtggctgtggaaggagctcggcaagaagaagacgccccggatgtgcacccgcgaggagttcaccaagaaggtgcggagcaacgccgccctgggggcgatcttcacggacgagaacaagtggaagtccgcccgcgaggccgtggaggacggccggttctgggagctggtcgaccgcgagcggaacctccacctggaggggaagtgcgagacctgcgtgtacaacatgatgggcaagcgcgagaagaagctgggggagttcggccgggccaagggcagccgcgcgatctggtacatgtggctcggggcccggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacaccgcgggctgggacacccggatcacgctggaggacctcaagaacgaggagatggtgaccaaccacatgaagggggagcacaagaagctggccgaggccatcttcaagctgacctaccagaacaaggtcgtgcgcgtgcagcggcccaccccgcgcggcacggtcatggacatcatctcccggcgcgaccagcgcggcagcgggcaggtcggcacctacgggctcaacaccttcaccaacatggaggcccagctgatccggcagatggagggcgagggcatcttcaagtccatccagcacctgacggccaccgaggagatcgcggtgcagaactggctcgcccgcgtcgggcgggagcgcctgagccggatggccatctccggcgacgactgcgtggtgaagcccatcgacgaccgcttcgccagcgccctgaccgcgctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcccgcatctcccagggcgccgggtggagcctgaaggagacggcctgcctgggcaagtcctacgcccagatgtggaccctcatgtacttccaccggcgcgacctgcggctggcggccaacgccatctgcagcgccgtcccctcccactgggtgcccaccagccgcaccacctggtccatccacgcgaagcacgagtggatgacgaccgaggacatgctcgccgtgtggaaccgggtctggatccaggagaacccctggatggaggacaagaccccggtggagagctgggaggaggtgccctacctggggaagcgcgaggaccagtggtgcggctccctgatcgggctcaccagccgggccacgtgggccaagaacatccagaccgccatcaaccaggtccgcagcctgatcggcaacgaggagtacaccgactacatgccctccatgaagcgcttccggcgcgaggaggaggaggcgggcgtgctgtggtga

SEQ ID NO: 9224 - RNA, 9876 nt, synthetic construct
  misc_feature 1..9876: note = derived and/or modified CDS sequence (opt1) from DENV-2__FJ205885__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcctcacctccatcgggaaggccctgcaccaggtgttcggcgcgatctacggcgccgccttcagcggggtgtcctggacgatgaagatcctgatcggcgtcatcatcacctggatcgggatgaacagccgctccaccagcctgtccgtgagcctcgtgctggtcggcgtggtgaccctgtacctcggggccgtcgtgcaggcggactccggctgcgtggtcagctggaagaacaaggagctgaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctcgagaacctgatgtggaagcagatcacgcccgagctgaaccacatcctctccgagaacgaggtcaagctgaccatcatgaccggcgacatcaaggggatcatgcaggccggcaagcggagcctgcgcccgcagcccaccgagctcaagtactcctggaagacgtggggcaaggcgaagatgctgagcaccgagtcccacaaccagaccttcctgatcgacgggcccgagaccgccgagtgcccgaacacgaaccgggcctggaacagcctcgaggtggaggactacggcttcggggtgttcaccaccaacatctggctgaagctgcgcgagaagcaggacgtcttctgcgactccaagctcatgagcgccgccatcaaggacaaccgggcggtgcacgccgacatgggctactggatcgagtccgccctgaacgacacctggaagatggagaaggccagcttcatcgaggtgaagtcctgccactggcccaagagccacaccctgtggtccaacggcgtcctcgagagcgagatgatcatccccaagaacttcgccgggcccgtgtcccagcacaactaccgcccgggctaccacacgcagaccgcggggccctggcacctgggcaagctggagatggacttcgacttctgcgaggggaccaccgtggtcgtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacccgcatcggcacgaagcacgcgatcctcctggtggccgtcagcttcgtgaccctgatcaccgggaacatgtccttccgggacctcggccgcgtgatggtcatggtgggggccaccatgacggacgacatcggcatgggcgtgacctacctggccctgctcgccgcgttcaaggtccgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtgctcaagatcgtgcgcaacatggagaagtaccagctggccgtcacgatcatggccatctcctgcgtgccgaacgccgtgatcctgcagaacgcgtggaaggtcagctgcaccatcctcgccgccgtgtccgtcagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtgggcatggtgagcatcctggcctccagcctgctcaagaacgacatccccatgacggggcccctggtcgcgggcgggctgctcaccgtgtgctacgtgctgaccggccggagcgccgacctggagctcgagcgcgccgccgacgtcaagtgggaggaccaggccgagatctccgggagctcccccatcctgagcatcaccatctccgaggacggcagcatgtccatcaagaacgaggaggaggagcagacgctgaccatcctcatccggaccggcctgctggtgatcagcggggtgttcccggtctccatccccatcaccgcggccgcctggtacctctgggaggtgaagaagcagcgcgccggcgtgctgtgggacgtccccagcccgccgcccgtggagaaggccgagctggaggacggggcgtaccggatcaagcagcgcggcatcctcgggtactcccagatcggcgccggcgtgtacaaggaggggaccttccacacgatgtggcacgtcacccggggcgccgtgctgatgcaccgcgggaagcggatcgagcccagctgggccgacgtgaagaaggacctgatctcctacggcgggggctggaagctcgagggcgagtggaaggagggggaggaggtccaggtgctggccctggagcccggcaagaacccccgcgcggtgcagaccaagcccgggatcttcaagaccaacacgggcaccatcggggccgtcagcctcgacttctcccccggcaccagcggctcccccatcgtggaccggaaggggaaggtggtcggcctgtacgggaacggcgtggtgacccgcagcggcgcctacgtctccgccatcgcgcagacggagaagtccatcgaggacaaccccgagatcgaggacgacatcttccggaagaagcgcctgaccatcatggacctccaccccggggccggcaagaccaagcggtacctgcccgccatcgtgcgcgaggccatcaagcgggggctgcgcaccctgatcctcgccccgacgcgcgtggtcgcggccgagatggaggaggccctgcggggcctgcccatccgctaccagacccccgccatcaagaccgagcacaccgggcgggagatcgtggacctcatgtgccacgccacgttcaccatgcgcctgctgagccccgtgcgggtcccgaactacaacctcatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctgcggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctcacggacggggaggagcgggtgatcctggcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtggacgcgatcgacggcgagtaccgcctgcgcggggaggcccgcaagaccttcgtggacctcatgcggcgcggcgacctgcccgtctggctggcctacaaggtggccgccgaggggatcaactacacggaccggaagtggtgcttcgacggcatcaagaacaaccagatcctcgaggagaacatggaggtggagatctggaccaaggagggggagcgcaagaagctgaagccgcggtggctggacgcgcgcatctacagcgaccccctcgccctgaaggagttcaaggagttcgccgccggccggaagtccctgaccctcaacctgatcaccgagatgggccgcctgcccacgttcatgacccagaaggcgcggaacgccctcgacaacctggccgtcctgcacaccgccgaggccgggggccgcgcgtacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggccagcatcctcctgtggtacgcccagatccagccgcactggatcgcggcctccatcatcctggagttcttcctcatcgtcctgctgatccccgagcccgagaagcagcggacgccccaggacaaccagctcacctacgtggtgatcgccatcctgaccgtcgtggccgccacgatggcgaacgagatgggcttcctggagaagaccaagaaggacctcgggctgggcagcatcaccacccaggagagcgagtccaacatcctggacatcgacctccgcccggccagcgcctggacgctgtacgccgtggccaccaccttcgtcacccccatgctgcggcactccatcgagaacagctccgtgaacgtgagcctcacggcgatcgccaaccaggccaccgtcctgatgggcctggggaagggctggcccctctccaagatggacatcggggtgcccctgctggccatcggctgctacagccaggtgaacccgatcaccctcaccgcggccctgctgctcctggtcgcccactacgccatcatcgggcccggcctgcaggccaaggcgacgcgcgaggcccagaagcgggccgccgccggcatcatgaagaaccccaccgtggacgggatcaccgtgatcgacctcgagcccatcccgtacgaccccaagttcgagaagcagctgggccaggtcatgctgctcatcctgtgcgtgacccaggtgctgatgatgcgcacgacctgggcgctctgcgaggccctgaccctggccaccgggcccatctccacgctctgggagggcaaccccgggcggttctggaacaccaccatcgccgtcagcatggccaacatcttccgcggctcctacctggcgggcgccgggctcctgttcagcatcatgaagaacaccacgtccacccgccggggcaccgggaacatcggcgagaccctgggcgagaagtggaagtcccgcctgaacgccctcgggaagtccgagttccagatctacaagaagtccggcatccaggaggtggaccggacgctggccaaggaggggatcaagcgcggcgagaccgaccaccacgcggtgtcccgggggagcgccaagctgcgctggttcgtcgagcggaacatggtgaccccggagggcaaggtggtcgacctcggctgcgggcgcggcgggtggtcctactactgcggcgggctgaagaacgtgcgggaggtgaagggcctgaccaagggcgggcccggccacgaggagcccatccccatgagcacgtacgggtggaacctcgtccgcctgcagagcggcgtggacgtgttcttcaccccgcccgagaagtgcgacaccctgctctgcgacatcggggagtccagccccaaccccaccatcgaggccggccggaccctgcgcgtcctgaacctcgtggagaactggctgaacaacaacacgcagttctgcatcaaggtgctgaacccgtacatgccctccgtcatcgagaagatggaggccctccagcggcagtacggcggggccctggtgcgcaaccccctgagccggaactccacccacgagatgtactgggtgagcaacgcgaccggcaacatcgtctccagcgtgaacatgatctcccgcatgctgatcaaccggttcaccatgaagcacaagaaggccacgtacgagccggacgtggacctcgggagcggcacccgcaacatcgggatcgagtccgagatccccaacctggacatcatcggcaagcggatcgagaagatcaagcaggagcacgagatcagctggcactacgaccaggaccacccctacaagacctgggcctaccacggctcctacgagaccaagcagacggggagcgcctccagcatggtcaacggcgtggtgcgcctgctcaccaagccctgggacgtcgtgccgatggtgacccagatggccatgaccgacacgacccccttcgggcagcagcgcgtcttcaaggagaaggtggacacccggacccaggagcccaaggagggcacgaagaagctgatgaagatcaccgcggagtggctgtggaaggagctcggcaagaagaagacgccccgcatgtgcacccgggaggagttcacgcgcaaggtgcggtccaacgccgccctgggggccatcttcaccgacgagaacaagtggaagtccgcccgcgaggcggtcgaggacggccggttctgggagctggtggaccgcgagcggaacctccacctggaggggaagtgcgagacctgcgtgtacaacatgatgggcaagcgcgagaagaagctgggggagttcggcaaggccaagggctcccgggccatctggtacatgtggctcggggcccgcttcctggagttcgaggcgctgggcttcctcaacgaggaccactggttcagccgggggaacagcctgtccggcgtcgagggggagggcctgcaccgcctcggctacatcctgcgggacgtggggaagaaggagggcggggccatgtacgccgacgacaccgccggctgggacacgcgcatcaccctggaggacctcaagaacgaggagatggtcaccaaccacatgaagggggagcacaagaagctggccgaggcgatcttcaagctgacctaccagaacaaggtggtgcgggtccagcgcccgacgccccggggcaccgtgatggacatcatcagccgccgggaccagcgcggctccgggcaggtcggcacctacgggctcaacaccttcacgaacatggaggcccagctgatccgccagatggagggcgagggcatcttcaagagcatccagcacctgaccgccaccgaggagatcgccgtccagaactggctcgcccgggtggggcgcgagcggctgtcccgcatggcgatcagcggcgacgactgcgtggtcaagcccatcgacgaccggttcgcctccgccctgaccgccctcaacgacatggggaaggtgcgcaaggacatccagcagtgggagcccagccggggctggaacgactggacccaggtgccgttctgctcccaccacttccacgagctggtcatgaaggacgggcgcgtgctggtggtcccctgccggaaccaggacgagctcatcggccgcgcccggatcagccagggcgcggggtggtccctgaaggagaccgcctgcctgggcaagagctacgcccagatgtggaccctcatgtacttccaccgccgggacctgcgcctggccgccaacgcgatctgctccgccgtgcccagccactgggtgcccacctcccggaccacgtggagcatccacgccaagcacgagtggatgaccaccgaggacatgctcgccgtctggaaccgcgtgtggatccaggagaacccgtggatggaggacaagacccccgtggagtcctgggaggaggtcccctacctggggaagcgggaggaccagtggtgcggcagcctgatcgggctcacgagccgcgcgacctgggccaagaacatccagaccgccatcaaccaggtgcggtccctgatcggcaacgaggagtacaccgactacatgcccagcatgaagcgcttccgccgggaggaggaggaggccggcgtgctgtggtga

SEQ ID NO: 9225 - RNA, 9876 nt, synthetic construct
  misc_feature 1..9876: note = derived and/or modified CDS sequence (opt1) from DENV-2__FJ744743__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccggcaaggacagccccgtgaacatcgaggcggagccgcccttcggggactcctacatcatcatcggcgtggagccggggcagctgaagctcaactggttcaagaagggcagctccatcggccagatgttcgagacgaccatgcgcggggccaagcggatggccatcctgggcgacaccgcctgggacttcgggagcctgggcggggtcttcacctccatcggcaaggccctccaccaggtgttcggcgcgatctacggggccgccttcagcggcgtgtcctggacgatgaagatcctgatcggggtcatcatcacctggatcggcatgaacagccgctccaccagcctgtccgtgagcctggtgctcgtcggggtggtgaccctgtacctgggcgccgtcgtgcaggcggactccggctgcgtggtcagctggaagaacaaggagctcaagtgcgggtccggcatcttcatcacggacaacgtgcacacctggaccgagcagtacaagttccagcccgagagccccagcaagctggcctccgccatccagaaggcccacgaggaggggatctgcggcatccggagcgtgacccgcctggagaacctcatgtggaagcagatcacgcccgagctgaaccacatcctgtccgagaacgaggtcaagctcaccatcatgaccggggacatcaagggcatcatgcaggccggcaagcggagcctgtggccgcagcccaccgagctgaagtactcctggaagacgtgggggaaggcgaagatgctcagcaccgagtcccacaaccagaccttcctgatcgacggccccgagaccgccgagtgcccgaacacgaaccgcgcctggaacagcctggaggtggaggactacgggttcggcgtgttcaccaccaacatctggctcaagctgcgggagaagcaggacgtcttctgcgactccaagctgatgagcgccgccatcaaggacaaccgcgcggtgcacgccgacatgggctactggatcgagtccgccctcaacgacacctggaagatggagaaggccagcttcatcgaggtgaagtcctgccactggcccaagagccacaccctgtggtccaacggggtcctggagagcgagatgatcatccccaagaacttcgccggccccgtgtcccagcacaactaccggccggggtaccacacgcagaccgcgggcccctggcacctcgggaagctggagatggacttcgacttctgcgagggcaccaccgtggtcgtgacggaggactgcggcaaccgcgggcccagcctgcggaccaccaccgccagcggcaagctcatcacggagtggtgctgccgctcctgcaccctgcccccgctgcggtaccgcggggaggacggctgctggtacgggatggagatccggcccctcaaggagaaggaggagaacctggtgaacagcctggtcaccgccggccacggccagatcgacaacttctccctcggggtgctgggcatggccctgttcctcgaggagatgctgcgcacccggatcgggacgaagcacgcgatcctgctcgtggccgtcagcttcgtgaccctgatcaccggcaacatgtccttccgcgacctggggcgggtgatggtcatggtgggcgccaccatgacggacgacatcggcatgggggtgacctacctcgccctgctggccgcgttcaaggtccgccccaccttcgccgccggcctcctgctgcgcaagctcaccagcaaggagctgatgatggccacgatcgggatcgccctgctctcccagagcaccatccccgagaccatcctggagctgaccgacgcgctcgccctgggcatgatggtgctgaagatcgtgcggaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccgcaccagcaagaagcggtcctggccgctgaacgaggccatcatggccgtggggatggtgagcatcctcgcctccagcctgctgaagaacgacatccccatgacgggccccctcgtcgccggcgggctgctgaccgtgtgctacgtgctcaccgggcgcagcgccgacctggagctggagcgggccgccgacgtcaagtgggaggaccaggccgagatctccgggagctcccccatcctcagcatcaccatctccgaggacggcagcatgtccatcaagaacgaggaggaggagcagacgctgaccatcctgatccgcaccgggctcctggtgatcagcggcgtgttcccggtctccatccccatcaccgcggccgcctggtacctgtgggaggtgaagaagcagcgggccggggtgctctgggacgtccccagcccgccgcccgtggagaaggccgagctggaggacggcgcgtaccgcatcaagcagcgggggatcctgggctactcccagatcggcgccggggtgtacaaggagggcaccttccacacgatgtggcacgtcacccgcggggccgtgctcatgcaccggggcaagcgcatcgagcccagctgggccgacgtgaagaaggacctgatctcctacgggggcggctggaagctggagggggagtggaaggagggcgaggaggtccaggtgctcgccctggagcccgggaagaacccccgggcggtgcagaccaagcccggcatcttcaagaccaacacggggaccatcggcgccgtcagcctggacttctcccccggcaccagcgggtcccccatcgtggaccgcaagggcaaggtggtcgggctctacggcaacggcgtggtgacccggagcggggcctacgtctccgccatcgcgcagacggagaagtccatcgaggacaaccccgagatcgaggacgacatcttccgcaagaagcggctgaccatcatggacctgcaccccggcgccgggaagaccaagcgctacctccccgccatcgtgcgggaggccatcaagcgcggcctgcggaccctgatcctggccccgacgcgcgtggtcgcggccgagatggaggaggccctccgcgggctgcccatccggtaccagacccccgccatcaagaccgagcacaccggccgcgagatcgtggacctgatgtgccacgccacgttcaccatgcggctcctgagccccgtgcgcgtcccgaactacaacctgatcatcatggacgaggcgcacttcaccgaccccgcctccatcgccgcccggggctacatcagcacccgcgtggagatgggggaggccgcgggcatcttcatgacggccacgccgcccgggtcccgggacccgttcccccagagcaacgcccccatcatggacgaggagcgcgagatccccgagcggtcctggaacagcggccacgagtgggtgaccgacttcaaggggaagaccgtctggttcgtgccgtccatcaaggccggcaacgacatcgcggcctgcctccgcaagaacggcaagaaggtgatccagctgagccggaagacgttcgactccgagtacgtcaagacccgcgccaacgactgggacttcgtggtgaccaccgacatcagcgagatgggggccaacttcaaggccgagcgggtcatcgacccccgccggtgcatgaagcccgtgatcctgacggacggcgaggagcgcgtgatcctcgcggggcccatgccggtcacccactccagcgccgcccagcggcgcggccggatcgggcgcaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgcgagaaggtggacgcgatcgacggggagtaccggctgcgcggcgaggcccggaagaccttcgtggacctgatgcgccgcggggacctccccgtctggctggcctacaaggtggccgccgagggcatcaactacgcggaccgcaagtggtgcttcgacgggatcaagaacaaccagatcctggaggagaacatggaggtggagatctggacgaaggagggcgagcggaagaagctcaagccgcgctggctggacgcccggatctacagcgaccccctggccctcaaggagttcaaggagttcgccgcgggccgcaagtccctgaccctgaacctcatcaccgagatggggcggctgcccaccttcatgacgcagaaggcccgcaacgccctggacaacctcgccgtcctgcacaccgccgaggcgggcgggcgggcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcatcctgctctggtacgcgcagatccagccgcactggatcgccgcctccatcatcctggagttcttcctgatcgtcctcctgatccccgagcccgagaagcagcgcacgccccaggacaaccagctgacctacgtggtgatcgccatcctcaccgtcgtggccgcgaccatggccaacgagatggggttcctggagaagacgaagaaggacctgggcctcggcagcgtgaccacccaggagagcgagtccaacatcctggacatcgacctgcggccggccagcgcctggaccctctacgccgtcgcgacgaccttcgtgacccccatgctgcgccactccatcgagaacagctccgtgaacgtcagcctgaccgccatcgccaaccaggccacggtgctcatggggctgggcaaggggtggcccctgtccaagatggacatcggcgtgcccctcctggcgatcgggtgctacagccaggtcaacccgatcaccctgaccgccaccctcctgcggttcgtggcccagtacgccatcatcggccccggcctgcaggccaaggcgacgcgcgaggcccagaagcgggccgccgccgggatcatgaagaaccccaccgtggacggcatcaccgtcatcgacctcgagcccatcccgtacgaccccaagttcgagaagcagctggggcaggtcatgctgctcatcctgtgcgtgacccaggtcctgatgatgcgcacgacctgggcgctctgcgaggccctgaccctggccaccggccccatctccacgctctgggaggggaaccccggccggttctggaacaccaccatcgccgtgagcatggccaacatcttccgcggctcctacctggcgggggccggcctcctcttcagcatcatgaagaacaccacgtccacccgccgggggaccggcaacatcggcgagaccctgggggagaagtggaagtcccgcctgaacgccctcggcaagtccgagttccagatctacaagaagtccgggatccaggaggtggaccggacgctggccaaggagggcatcaagcgcggggagaccgaccaccacgcggtctcccggggcagcgccaagctgcgctggttcgtggagcggaacatggtgaccccggagggcaaggtcgtggacctcgggtgcggccgcgggggctggtcctactactgcgggggcctgaagaacgtgcgggaggtcaagggcctgaccaagggcgggcccgggcacgaggagcccatccccatgagcacgtacggctggaacctcgtgcgcctgcagagcggggtggacgtcttcttcaccccgcccgagaagtgcgacaccctgctctgcgacatcggcgagtccagccccaaccccaccatcgaggccggccggaccctgcgcgtgctgaacctcgtggagaactggctgaacaacaacacgcagttctgcatcaaggtcctgaacccgtacatgccctccgtgatcgagaagatggaggccctccagcggcagtacgggggcgccctggtgcgcaaccccctgagccggaactccacccacgagatgtactgggtcagcaacgcgaccgggaacatcgtgtccagcgtgaacatgatctcccgcatgctcatcaaccggttcaccatgaagcacaagaaggccacgtacgagccggacgtcgacctgggcagcgggacccgcaacatcggcatcgagtccgagatccccaacctggacatcatcggcaagcggatcgagaagatcaagcaggagcacgagatcagctggcactacgaccaggaccacccctacaagacctgggcctaccacgggtcctacgagaccaagcagacgggcagcgcctccagcatggtgaacggggtggtccgcctgctcaccaagccctgggacgtggtgccgatggtcacccagatggccatgaccgacacgacccccttcggccagcagcgcgtgttcaaggagaaggtggacacccggacccaggagcccaaggagggcacgaagaagctgatgaagatcaccgcggagtggctgtggaaggagctcgggaagaagaagacgccccgcatgtgcacccgggaggagttcacgaagaaggtccgctccaacgccgccctgggcgccatcttcaccgacgagaacaagtggaagtccgcccgggaggcggtggaggacgggcgcttctgggagctggtggaccgggagcgcaacctccacctggagggcaagtgcgagacctgcgtctacaacatgatggggaagcgggagaagaagctgggcgagttcggcaaggccaaggggtcccgcgccatctggtacatgtggctcggcgcccggttcctggagttcgaggcgctggggttcctcaacgaggaccactggttcagccgcggcaacagcctgtccggggtggagggcgagggcctgcaccggctcgggtacatcctgcgcgacgtcggcaagaaggagggcggggccatgtacgccgacgacaccgccgggtgggacacgcggatcaccctggaggacctcaagaacgaggagatggtgaccaaccacatgaagggcgagcacaagaagctggccgaggcgatcttcaagctgacctaccagaacaaggtggtccgcgtgcagcggccgacgccccgcggcaccgtgatggacatcatcagccggcgcgaccagcgggggtccggccaggtcgggacctacggcctcaacaccttcacgaacatggaggcccagctgatccgccagatggagggcgaggggatcttcaagagcatccagcacctgaccgccatcgaggagatcgccgtgcagaactggctcgcccgcgtgggccgggagcgcctgtcccggatggcgatcagcggggacgactgcgtcgtgaagcccatcgacgaccgcttcgcctccgccctgaccgccctcaacgacatgggcaaggtgcggaaggacatccagcagtgggagcccagccgcgggtggaacgactggacccaggtcccgttctgctcccaccacttccacgagctggtgatgaaggacggccgggtgctggtcgtgccctgccgcaaccaggacgagctcatcggccgggcccgcatcagccagggggcgggctggtccctgaaggagacggcctgcctgggcaagagctacgcccagatgtggaccctcatgtacttccaccggcgcgacctgcggctggccgccaacgcgatctgctccgccgtgcccagccactgggtccccacctcccgcaccacctggagcatccacgccaagcacgagtggatgacgaccgaggacatgctcgccgtgtggaaccgggtgtggatccaggagaacccgtggatggaggacaagacccccgtcgagtcctgggaggaggtgccctacctgggcaagcgcgaggaccagtggtgcgggagcctgatcggcctcaccagccgggcgacgtgggccaagaacatccagaccgccatcaaccaggtgcgctccctgatcggcaacgaggagtacaccgactacatgcccagcatgaagcggttccgccgcgaggaggaggaggccggggtcctgtggtga

SEQ ID NO: 9226 - RNA, 9876 nt, synthetic construct
  misc_feature 1..9876: note = derived and/or modified CDS sequence (opt1) from DENV-2__JN819424__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgcctccagcatcgacaaccgggccgtgcacgcggacatgggctactggatggagtccgcccccagcgactcctgcaagatggagaaggccagcttcatcgaggacaagtcctgctactggcccaacagccagcacctctggagcaacggcgtgctggagtccgagatgatcttccccaagaacttcgccgggccggtcagccagcacatctaccgccccggctaccacacccagaccgccgggccctgcaacctgggcaagctcgagatggacttcgacttctgcgaggggacgaccgtggtggtcaccgaggactgcggcaaccggggcccctccctgcgcaccacgaccgcgagcgggaagctgatcaccgagtggtgctgccggtcctgcaccctcccgcccctgcgctaccggggcgaggacgggtgctggtacggcatggagatccgccccctgaaggagaaggaggagaacctcgtgaacagcctggtgacggccgggcacggccagatcgacaacttctccctgggcgtcctcgggatggccctgttcctggaggagatgctccggacccgcatcggcaccaagcacgccatcctgctggtggcggtgagcttcgtcaccctcatcacggggaacatgtccttccgggacctgggccgcgtgatggtgatggtcggggccaccatgaccgacgacatcggcatgggcgtgacctacctggccctcctggccgccttcaaggtgcgccccacgttcgcggccgggctgctcctgcggaagctgaccagcaaggagctcatgatggccaccatcggcatcgccctgctgtcccagagcaccatcccggagacgatcctcgagctgaccgacgccctggcgctcgggatgatggtcctgaagatcgtgcgcaacatggagaagtaccagctggccgtgaccatcatggccatctcctgcgtccccaacgccgtgatcctccagaacgcctggaaggtgagctgcaccatcctggcggccgtctccgtgagccccctgctcctgacgtccagccagcagaaggccgactggatccccctggccctcaccatcaagggcctgaacccgaccgcgatcttcctgaccacgctctcccggaccagcaagaagcgcagctggcccctgaacgaggccatcatggccgtcggcatggtgtccatcctggccagctccctcctgaagaacgacatccccatgaccgggcccctggtggccggcgggctcctgaccgtctgctacgtgctgacgggccggagcgcggacctcgagctggagcgcgccgccgacgtgaagtgggaggaccaggccgagatctccgggagctccccgatcctgagcatcaccatctccgaggacggcagcatgtccatcaagaacgaggaggaggagcagaccctcaccatcctgatccggacgggcctgctcgtcatcagcggggtgttccccgtgtccatccccatcaccgccgcggcctggtacctgtgggaggtcaagaagcagcgcgccggcgtgctgtgggacgtgcccagcccgccgcccgtcgagaaggccgagctcgaggacggggcctaccggatcaagcagcgcggcatcctggggtactcccagatcggcgcgggcgtgtacaaggaggggaccttccacaccatgtggcacgtgacccggggcgccgtcctgatgcaccgcgggaagcggatcgagccgagctgggccgacgtgaagaaggacctcatctcctacggcgggggctggaagctggagggcgagtggaaggagggggaggaggtgcaggtcctggccctcgagcccggcaagaacccccgcgccgtgcagacgaagcccgggatcttcaagaccaacaccggcaccatcggggcggtgagcctggacttctccccgggcacgagcggcagccccatcgtcgaccggaaggggaaggtggtgggcctgtacgggaacggcgtcgtgacccgctccggcgcctacgtgagcgccatcgcccagaccgagaagtccatcgaggacaaccccgagatcgaggacgacatcttccggaagaagcgcctcaccatcatggacctgcaccccggggcgggcaagacgaagcggtacctgccggccatcgtccgcgaggccatcaagcgggggctccgcaccctgatcctggcccccacccgcgtggtggccgcggagatggaggaggccctgcggggcctccccatccgctaccagacccccgccatcaagacggagcacaccgggcgggagatcgtcgacctgatgtgccacgccaccttcaccatgcgcctgctcagcccggtgcgggtgcccaactacaacctgatcatcatggacgaggcccacttcacggaccccgcgtccatcgccgcccgcggctacatcagcacccgggtcgagatgggcgaggccgccgggatcttcatgaccgcgacgccgcccggctcccgcgaccccttcccccagagcaacgcccccatcatggacgaggagcgggagatccccgagcgctcctggaacagcgggcacgagtgggtgacggacttcaagggcaagaccgtgtggttcgtcccctccatcaaggccgggaacgacatcgccgcgtgcctgcggaagaacggcaagaaggtgatccagctcagccgcaagaccttcgactccgagtacgtgaagacccgggccaacgactgggacttcgtcgtgacgaccgacatcagcgagatgggcgccaacttcaaggccgagcgcgtgatcgacccccggcgctgcatgaagcccgtcatcctgaccgacggggaggagcgggtgatcctggccggcccgatgcccgtgacccactccagcgcggcccagcgccgggggcgcatcggccgcaaccccaagaacgagaacgaccagtacatctacatgggggagcccctcgagaacgacgaggactgcgcccactggaaggaggccaagatgctgctggacaacatcaacacgccggagggcatcatcccctccatgttcgagcccgagcgggagaaggtcgaggccatcgacggcgagtaccgcctccgcggggaggcgcgcaagaccttcgtggacctgatgcggcgcggcgacctgccggtgcggctcgcctacaaggtcgccgccgaggggatcaactacgccgaccgcaagtggtgcttcgacggcatcaagaacagccagatcctggaggagaacatggaggtggagatctggaccaaggagggggagcggaagaagctgaagccccgctggctcgacgcgcggatctactccgaccccctggccctgaaggagttcaaggagttcgccgccggccgcaagagcctcaccctgaacctgatcacggagatgggccggctccccaccttcatgacccagaaggcgcgcaacgccctggacaacctggccgtgctccacaccgccgaggccgggggccgggcgtacaaccacgccctgagcgagctgccggagacgctcgagaccctgctgctcctgaccctgctcgccaccgtcaccgggggcatcttcctgttcctgatgtccggcaaggggatcggcaagatgaccctcgggatgtgctgcatcatcaccgccagcatcctgctgtggtacgcccagatccagccccactggatcgcggcctccatcatcctcgagttcttcctgatcgtgctgctcatccccgagcccgagaagcagcgcaccccgcaggacaaccagctgacctacgtcgtgatcgccatcctgacggtggtcgccgccaccatggcgaacgagatgggcttcctcgagaagaccaagaaggacctggggctgggcagcatcaccacgcaggagtccgagagcaacatcctcgacatcgacctgcggcccgcctccgcctggaccctgtacgccgtggccaccaccttcgtgacgcccatgctccgccacagcatcgagaactccagcgtcaacgtgtccctgaccgcgatcgccaaccaggccaccgtgctgatgggcctcgggaagggctggcccctgagcaagatggacatcggggtcccgctgctcgccatcggctgctactcccaggtgaaccccatcaccctgacggcggccctgctcctgctggtggcccactacgccatcatcgggcccggcctccaggccaaggcgacccgggaggcccagaagcgcgccgccgccggcatcatgaagaaccccaccgtcgacgggatcaccgtgatcgacctggagccgatcccctacgaccccaagttcgagaagcagctgggccaggtgatgctcctgatcctgtgcgtcacccaggtcctcatgatgcggaccacctgggcgctgtgcgaggccctgaccctcgccacggggcccatcagcaccctgtgggagggcaacccggggcgcttctggaacaccaccatcgccgtgtccatggccaacatcttccgcggcagctacctggcgggcgccgggctcctgttctccatcatgaagaacacgaccagcacccggcgcggcaccgggaacatcggcgagacgctgggcgagaagtggaagtcccggctcaacgccctgggcaagagcgagttccagatctacaagaagtccggcatccaggaggtcgaccgcaccctggccaaggaggggatcaagcggggcgagaccgaccaccacgcggtgtcccgcgggagcgccaagctccggtggttcgtggagcgcaacatggtcacccccgagggcaaggtggtggacctgggctgcgggcggggcgggtggtcctactactgcggcgggctgaagaacgtccgcgaggtgaagggcctcacgaagggcgggcccggccacgaggagcccatcccgatgagcacctacgggtggaacctggtgcggctgcagtccggcgtcgacgtgttcttcacgccgcccgagaagtgcgacaccctcctgtgcgacatcggggagagctcccccaacccgacgatcgaggccggccgcaccctgcgggtgctcaacctggtcgagaactggctgaacaacaacacccagttctgcatcaaggtgctcaacccctacatgcccagcgtgatcgagaagatggaggccctgcagcgccagtacggcggggccctggtccggaacccgctctcccgcaacagcacccacgagatgtactgggtgtccaacgcgaccggcaacatcgtgagctccgtcaacatgatcagccggatgctgatcaaccgcttcacgatgaagcacaagaaggccacctacgagcccgacgtggacctggggtccggcacccggaacatcgggatcgagagcgagatccccaacctggacatcatcggcaagcgcatcgagaagatcaagcaggagcacgagatctcctggcactacgaccaggaccacccctacaagacctgggcctaccacggcagctacgagacgaagcagaccgggtccgccagcagcatggtgaacggcgtcgtgcgcctcctgaccaagccgtgggacgtggtccccatggtgacccagatggccatgacggacaccacccccttcgggcagcagcgggtgttcaaggagaaggtcgacacccgcacgcaggagcccaaggagggcaccaagaagctgatgaagatcaccgcggagtggctctggaaggagctgggcaagaagaagaccccgcggatgtgcacgcgcgaggagttcaccaagaaggtgcggtccaacgccgccctgggggccatcttcaccgacgagaacaagtggaagtccgcccgcgaggcggtggaggacggccggttctgggagctcgtcgaccgcgagcggaacctgcacctggaggggaagtgcgagacctgcgtgtacaacatgatgggcaagcgcgagaagaagctcggggagttcggcaaggccaagggctcccgggccatctggtacatgtggctgggggcccgcttcctggagttcgaggcgctcggcttcctgaacgaggaccactggttcagccgggggaactccctgagcggcgtggagggggagggcctccaccgcctgggctacatcctgcgggacgtcgggaagaaggagggcggggccatgtacgccgacgacacggccggctgggacacccgcatcaccctcgaggacctgaagaacgaggagatggtgaccaaccacatgaagggggagcacaagaagctggccgaggcgatcttcaagctcacgtaccagaacaaggtcgtgcgggtgcagcgccccacgccccggggcaccgtcatggacatcatctcccgccgggaccagcgcggcagcggccaggtgggcacctacgggctgaacacgttcaccaacatggaggcccagctgatccgccagatggagggcgagggcatcttcaagtccatccagcacctcaccgccaccgaggagatcgccgtgcagaactggctggcccgggtcgggcgcgagcggctgagccgcatggcgatctccggcgacgactgcgtggtgaagcccatcgacgaccggttcgccagcgccctcacggccctgaacgacatggggaaggtccgcaaggacatccagcagtgggagccgtcccggggctggaacgactggacccaggtgcccttctgcagccaccacttccacgagctggtgatgaaggacgggcgcgtcctcgtggtgccctgccggaaccaggacgagctgatcggccgcgcccggatctcccagggcgcggggtggagcctgaaggagaccgcctgcctcggcaagtcctacgcccagatgtggaccctgatgtacttccaccgccgggacctgcgcctcgccgccaacgcgatctgcagcgccgtccccagccactgggtgccgacgtcccggaccacctggagcatccacgccaagcacgagtggatgaccaccgaggacatgctggccgtgtggaaccgcgtctggatccaggagaacccctggatggaggacaagacgcccgtggagtcctgggaggaggtgccctacctggggaagcgggaggaccagtggtgcggcagcctcatcgggctgacctcccgcgcgacctgggccaagaacatccagaccgccatcaaccaggtccggagcctgatcggcaacgaggagtacacggactacatgccgtccatgaagcgcttccgccgggaggaggaggaggccggcgtgctctggtga

SEQ ID NO: 9227 - RNA, 9876 nt, synthetic construct
  misc_feature 1..9876: note = derived and/or modified CDS sequence (opt1) from DENV-2__FJ744741__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggcgcgtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgccatcgcgcagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgcgggctgcggaccctgatcctcgccccgacgcgcgtggtggcggccgagatggaggaggccctgcggggcctgcccatccgctaccagaccaccgccatcaagaccgagcacacggggcgggagatcgtcgacctcatgtgccacgccaccttcaccatgcgcctgctgagccccgtgcgggtgcccaactacaacctcatcatcatggacgaggcgcacttcaccgacccggcctccatcgccgcccgcggctacatcagcacgcgggtcgagatgggcgaggccgcggggatcttcatgaccgccacgccgcccggctcccgcgaccccttcccgcagagcaacgcccccatcatggacgaggagcgggagatccccgagcgctcctggaacagcgggcacgagtgggtgaccgacttcaagggcaagacggtgtggttcgtcccctccatcaaggccgggaacgacatcgcggcctgcctgcggaagaacggcaagaaggtgatccagctgagccgcaagaccttcgactccgagtacgtgaagacccgggccaacgactgggacttcgtcgtgaccacggacatcagcgagatgggcgccaacttcaaggccgagcgcgtgatcgacccgcggcgctgcatgaagcccgtcatcctcaccgacggggaggagcgggtgatcctggcgggccccatgcccgtgacccactccagcgccgcccagcgccgcgggcggatcggccgcaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgggagaaggtcgacgcgatcgacggcgagtaccgcctgcgcggggaggcccgcaagacgttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggaccaaggagggggagcgcaagaagctgaagccccggtggctggacgcccgcatctacagcgacccgctcgccctgaaggagttcaaggagttcgccgcgggccggaagtccctgaccctcaacctgatcaccgagatgggccgcctgcccacgttcatgacccagaaggcccggaacgccctcgacaacctggccgtgctgcacaccgccgaggccgggggccgcgcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcggacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccgccccgccagcgcctggacgctgtacgccgtggcgaccaccttcgtgaccccgatgctgcggcactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgcgaggcccagaagcgggccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcgcacgacctgggccctctgcgaggccctgaccctggccaccgggcccatctccacgctctgggagggcaaccccgggcgcttctggaacaccaccatcgccgtgagcatggcgaacatcttccggggctcctacctggccggcgccgggctcctgttcagcatcatgaagaacaccacgaacacccgccggggcaccgggaacatcggcgagaccctgggcgagaagtggaagtcccgcctgaacgccctcggcaagagcgagttccagatctacaagaagtccggcatccaggaggtcgaccggacgctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgaccaagggcgggccgggccacgaggagcccatccccatgtccacgtacgggtggaacctcgtgcgcctgcagagcggcgtcgacgtgttcttcacgccgcccgagaagtgcgacaccctgctctgcgacatcggggagagctcccccaaccccaccatcgaggccggccggaccctgcgcgtgctgaacctcgtcgagaactggctgaacaacaacacgcagttctgcatcaaggtgctgaacccctacatgcccagcgtgatcgagaagatggaggccctccagcggaagtacggcggggcgctggtccgcaaccccctgtcccggaacagcacccacgagatgtactgggtgtccaacgccaccggcaacatcgtgagctccgtcaacatgatcagccgcatgctgatcaaccggttcaccatgaagcacaagaaggccacgtacgagcccgacgtggacctcgggtccggcacccgcaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcggctgctcaccaagccctgggacgtggtccccatggtgacccagatggcgatgacggacaccaccccgttcgggcagcagcgcgtgttcaaggagaaggtcgacacccggacgcaggagcccaaggagggcaccaagaagctgatgaagatcaccgccgagtggctgtggaaggagctcggcaagaagaagacgccccgcatgtgcacgcgggaggagttcacccgcaaggtgcggagcaacgccgccctgggggccatcttcaccgacgagaacaagtggaagtccgcgcgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggccatctggtacatgtggctcggggcgcgcttcctggagttcgaggccctgggcttcctcaacgaggaccactggttctcccgggggaacagcctgagcggcgtggagggggagggcctgcaccgcctcggctacatcctgcgggacgtcgggaagaaggagggcggggccatgtacgccgacgacacggccggctgggacacccgcatcaccctggaggacctcaagaacgaggagatggtgaccaaccacatgaagggggagcacaagaagctggcggaggccatcttcaagctgacgtaccagaacaaggtcgtgcgggtgcagcgccccaccccgcggggcaccgtcatggacatcatctcccgccgcgaccagcggggcagcgggcaggtcggcacctacgggctcaacacgttcaccaacatggaggcccagctgatccgccagatggagggcgagggcatcttcaagtccatccagcacctgaccgccaccgaggagatcgccgtgcagaactggctcgcgcgggtcgggcgcgagcggctgagccgcatggccatctccggcgacgactgcgtggtgaagcccatcgacgaccggttcgccagcgccctgacggccctcaacgacatggggaaggtccgcaaggacatccagcagtgggagccctcccggggctggaacgactggacccaggtgcccttctgcagccaccacttccacgagctggtgatgaaggacgggcgcgtcctggtggtgccgtgccggaaccaggacgagctcatcggccgcgcgcggatctcccagggcgccgggtggagcctgaaggagaccgcctgcctgggcaagtcctacgcccagatgtggaccctcatgtacttccaccgccgggacctgcgcctggccgcgaacgccatctgcagcgccgtcccctcccactgggtgcccaccagccggacgacctggtccatccacgccaagcacgagtggatgaccaccgaggacatgctcgcggtgtggaaccgcgtctggatccaggagaacccctggatggaggacaagacgccggtggagagctgggaggaggtgccctacctggggaagcgggaggaccagtggtgcggctccctgatcgggctcaccagccgcgccacctgggccaagaacatccagaccgccatcaaccaggtccgcagcctgatcggcaacgaggagtacacggactacatgccctccatgaagcggttccgccgggaggaggaggaggccggcgtgctgtggtga

SEQ ID NO: 9228 - RNA, 9876 nt, synthetic construct
  misc_feature 1..9876: note = derived and/or modified CDS sequence (opt1) from DENV-2__FJ744703__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggaccgacaagctccagctgaaggggatgtcctacagcatgtgcaccggcaagttcaagatcgtgaaggagatcgccgagacgcagcacgggaccatcgtgatccgcgtccagtacgagggcgacggctccccctgcaagatccccttcgagatcaccgacctggagaagcggcacgtgctcgggcgcctgatcaccgtgaacccgatcgtcacggagaaggacagccccgtgaacatcgaggcggagccgcccttcggcgactcctacatcatcatcggggtggagccgggccagctgaagctcaactggttcaagaaggggagctccatcggccagatgttcgagaccaccatgcgcggcgccaagcggatggccatcctgggggacaccgcctgggacttcggcagcctcgggggcgtcttcacgtccatcgggaaggccctccaccaggtgttcggcgcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccgtcgtgcaggcggactccggctgcgtggtcagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtgacgcgcctggagaacctcatgtggaagcagatcacccccgagctgaaccacatcccgtccgagaacgaggtcaagctgaccatcatgaccggcgacatcaaggggatcatgcaggccggcaagcggagcctccgcccccagcccacggagctgaagtactcctggaagacctggggcaaggcgaagatgctgagcaccgagtcccacaaccagaccttcctcatcgacgggccggagacggccgagtgccccaacaccaaccgggcctggaacagcctggaggtggaggactacggcttcggggtgttcaccaccaacatctggctgaagctccgcgagaagcaggacgtcttctgcgactccaagctgatgagcgccgccatcaaggacaaccgggcggtgcacgccgacatgggctactggatcgagtccgccctgaacgacacctggaagatggagaaggccagcttcatcgaggtgaagtcctgccactggcccaagagccacacgctctggtccaacggcgtcctggagagcgagatgatcatccccaagaacttcgccgggccggtgtcccagcacaactaccgccccggctaccacacccagaccgcggggccctggcacctgggcaagctcgagatggacttcgacttctgcgaggggaccacggtggtcgtgaccgaggactgcggcaaccggggccccagcctgcgcaccaccacggccagcgggaagctgatcaccgagtggtgctgccggtcctgcaccctcccgcccctgcgctaccggggcgaggacgggtgctggtacggcatggagatccgccccctgaaggagaaggaggagaacctcgtgaacagcctggtcaccgccgggcacggccagatcgacaacttctccctgggcgtgctcgggatggccctgttcctggaggagatgctccggacgcgcatcggcaccaagcacgcgatcctgctggtggccgtcagcttcgtgaccctcatcaccgggaacatgtccttccgggacctgggccgcgtgatggtcatggtgggggccacgatgaccgacgacatcggcatgggcgtgacctacctggccctcctggccgcgttcaaggtccgccccaccttcgccgccgggctgctcctgcggaagctgacgagcaaggagctcatgatggccaccatcggcatcgccctgctgtcccagagcaccatcccggagaccatcctcgagctgacggacgcgctggccctcgggatgatggtgctgaagatcgtgcgcaacatggagaagtaccagctggccgtcaccatcatggccatctcctgcgtgcccaacgccgtgatcctccagaacgcgtggaaggtcagctgcaccatcctggccgccgtgtccgtcagccccctgctcctgacctccagccagcagaaggccgactggatccccctggcgctcacgatcaagggcctgaacccgaccgccatcttcctgaccaccctctcccggacgagcaagaagcgctcctggcccctgaacgaggccatcatggccgtgggcatggtgagcatcctggcctccagcctcctgaagaacgacatccccatgaccgggcccctggtcgcgggcgggctcctgaccgtgtgctacgtgctgaccggccggagcgccgacctcgagctggagcgcgccgccgacgtcaagtgggaggaccaggccgagatctccgggagctccccgatcctgagcatcacgatctccgaggacggcagcatgtccatcaagaacgaggaggaggagcagaccctcaccatcctgatccggaccggcctgctcgtgatcagcggggtgttccccgtctccatccccatcaccgcggccgcctggtacctgtgggaggtgaagaagcagcgcgccggcgtgctgtgggacgtccccagcccgccgcccgtggagaaggccgagctcgaggacggggcgtaccggatcaagcagcgcggcatcctggggtactcccagatcggcgccggcgtgtacaaggaggggacgttccacaccatgtggcacgtcacccggggcgccgtgctgatgcaccgcgggaagcggatcgagccgagctgggccgacgtgaagaaggacctcatctcctacggcgggggctggaagctggagggcgagtggaaggagggggaggaggtccaggtgctggccctcgagcccggcaagaacccccgcgcggtgcagaccaagcccgggatcttcaagacgaacaccggcaccatcggggccgtcagcctggacttctccccgggcaccagcggctcccccatcgtggaccggaaggggaaggtggtcggcctgtacgggaacggcgtggtgacgcgcagcggcgcctacgtctccgccatcgcgcagaccgagaagtccatcgaggacaaccccgagatcgaggacgacatcttccggaagaagcgcctcaccatcatggacctgcaccccggggccggcaagaccaagcggtacctgccggccatcgtgcgcgaggccatcaagcgggggctccgcacgctgatcctggcccccacccgcgtggtcgcggccgagatggaggaggccctgcggggcctccccatccgctaccagacccccgccatcaagaccgagcacacggggcgggagatcgtggacctgatgtgccacgccaccttcaccatgcgcctgctcagcccggtgcgggtccccaactacaacctgatcatcatggacgaggcgcacttcaccgaccccgcctccatcgccgcccgcggctacatcagcacgcgggtggagatgggcgaggccgcggggatcttcatgaccgccacgccgcccggctcccgcgaccccttcccccagagcaacgcccccatcatggacgaggagcgggagatccccgagcgctcctggaacagcgggcacgagtgggtgaccgacttcaagggcaagacggtctggttcgtgccctccatcaaggccgggaacgacatcgcggcctgcctgcggaagaacggcaagaaggtgatccagctcagccgcaagaccttcgactccgagtacgtcaagacccgggccaacgactgggacttcgtggtgaccacggacatcagcgagatgggcgccaacttcaaggccgagcgcgtcatcgacccccggcgctgcatgaagcccgtgatcctgaccgacggggaggagcgggtgatcctggcgggcccgatgcccgtcacccactccagcgccgcccagcgccgggggcgcatcggccgcaaccccaagaacgagaacgaccagtacatctacatgggggagcccctcgagaacgacgaggactgcgcccactggaaggaggccaagatgctgctggacaacatcaacaccccggagggcatcatcccctccatgttcgagcccgagcgggagaaggtggacgcgatcgacggcgagtaccgcctccgcggggaggcccgcaagacgttcgtggacctgatgcggcgcggcgacctgccggtctggctcgcctacaaggtggccgccgaggggatcaactacgcggaccggaagtggtgcttcgacggcatcaagaacaaccagatcctggaggagaacatggaggtggagatctggaccaaggagggggagcgcaagaagctgaagccccggtggctcgacgcccgcatctacagcgaccccctggccctgaaggagttcaaggagttcgccgcgggccggaagtccctcaccctgaacctgatcaccgagatgggccgcctccccacgttcatgacccagaaggcccggaacgccctggacaacctggccgtcctccacaccgccgaggccgggggccgcgcctacaaccacgccctgagcgagctgccggagaccctcgagacgctgctgctcctgaccctgctcgccaccgtgaccgggggcatcttcctgttcctgatgtccggcaaggggatcggcaagatgaccctcgggatgtgctgcatcatcacggccagcatcctgctgtggtacgcgcagatccagccccactggatcgccgcctccatcatcctcgagttcttcctgatcgtcctgctcatccccgagcccgagaagcagcggaccccgcaggacaaccagctgacctacgtggtgatcgccatcctgaccgtcgtggccgcgacgatggccaacgagatgggcttcctcgagaagaccaagaaggacctggggctgggcagcatcaccacccaggagagcgagtccaacatcctcgacatcgacctgcgccccgccagcgcctggacgctgtacgccgtggcgaccaccttcgtcacccccatgctccggcactccatcgagaacagctccgtgaacgtgagcctgacggccatcgccaaccaggccaccgtcctgatgggcctcgggaagggctggcccctgtccaagatggacatcggggtgccgctgctcgcgatcggctgctacagccaggtgaaccccatcaccctgaccgccgccctgctcctgctggtcgcccactacgccatcatcgggcccggcctccaggcgaaggccacgcgcgaggcccagaagcgggccgccgcgggcatcatgaagaaccccaccgtggacgggatcaccgtgatcgacctggagccgatcccctacgaccccaagttcgagaagcagctgggccaggtcatgctcctgatcctgtgcgtgacccaggtgctcatgatgcgcacgacctgggccctgtgcgaggccctgaccctcgccaccgggcccatctccacgctgtgggagggcaacccggggcggttctggaacaccaccatcgccgtcagcatggcgaacatcttccgcggctcctacctggccggcgccgggctcctgttcagcatcatgaagaacaccacgtccacccgccggggcaccgggaacatcggcgagaccctgggcgagaagtggaagtcccgcctcaacgccctggggaagtccgagttccagatctacaagaagtccggcatccaggaggtggaccggacgctggcgaaggaggggatcaagcgcggcgagaccgaccaccacgccgtgtcccgggggagcgccaagctccgctggttcgtcgagcggaacatggtgacccccgagggcaaggtggtcgacctgggctgcgggcgcggcgggtggtcctactactgcggcgggctgaagaacgtgcgggaggtgaagggcctcaccaagggcgggcccggccacgaggagcccatcccgatgagcacgtacgggtggaacctggtccgcctgcagagcggcgtggacgtgttcttcacgccgcccgagaagtgcgacaccctcctgtgcgacatcggggagtccagccccaacccgaccatcgaggccggccggaccctgcgcgtcctcaacctggtggagaactggctgaacaacaacacgcagttctgcatcaaggtgctcaacccctacatgccctccgtcatcgagaagatggaggccctgcagcggcagtacggcggggcgctggtgcgcaacccgctcagccggaactccacccacgagatgtactgggtgagcaacgccaccggcaacatcgtctccagcgtgaacatgatctcccgcatgctgatcaaccggttcaccatgaagcacaagaaggccacgtacgagcccgacgtggacctggggagcggcacccgcaacatcgggatcgagtccgagatccccaacctggacatcatcggcaagcggatcgagaagatcaagcaggagcacgagatcagctggcactacgaccaggaccacccctacaagacctgggcctaccacggctcctacgagaccaagcagacggggagcgcctccagcatggtcaacggcgtggtgcgcctcctgaccaagccgtgggacgtcgtgcccatggtgacccagatggcgatgaccgacacgacccccttcgggcagcagcgcgtcttcaaggagaaggtggacacccggacccaggagcccaaggagggcacgaagaagctgatgaagatcaccgccgagtggctctggaaggagctgggcaagaagaagaccccgcgcatgtgcacccgggaggagttcacgaagaaggtgcgctccaacgccgccctgggggccatcttcaccgacgagaacaagtggaagtccgcgcgggaggccgtcgaggacggccgcttctgggagctcgtggaccgggagcgcaacctgcacctggaggggaagtgcgagacctgcgtgtacaacatgatgggcaagcgggagaagaagctcggggagttcggccgcgccaagggctcccgggccatctggtacatgtggctgggggcgcgcttcctggagttcgaggccctcggcttcctgaacgaggaccactggttcagccgggggaacagcctgtccggcgtcgagggggagggcctccaccgcctgggctacatcctgcgggacgtggggaagaaggagggcggggccatgtacgccgacgacaccgccggctgggacacgcgcatcaccctcgaggacctgaagaacgaggagatggtcaccaaccacatgaagggggagcacaagaagctggcggaggccatcttcaagctcacctaccagaacaaggtggtgcgggtccagcgccccacgccccggggcaccgtgatggacatcatcagccgccgggaccagcgcggctccgggcaggtcggcacctacgggctgaacaccttcacgaacatggaggcccagctgatccgccagatggagggcgagggcatcttcaagagcatccagcacctcaccgccaccgaggagatcgccgtccagaactggctggcgcgggtggggcgcgagcggctgtcccgcatggccatcagcggcgacgactgcgtggtcaagcccatcgacgaccggttcgcctccgccctcaccgccctgaacgacatggggaaggtgcgcaaggacatccagcagtgggagccgagccggggctggaacgactggacccaggtgcccttctgctcccaccacttccacgagctggtcatgaaggacgggcgcgtgctcgtggtcccctgccggaaccaggacgagctgatcggccgcgcgcggatcagccagggcgccgggtggtccctgaaggagaccgcctgcctcggcaagagctacgcccagatgtggaccctgatgtacttccaccgccgggacctgcgcctcgccgcgaacgccatctgctccgccgtgcccagccactgggtgccgacctcccggaccacgtggagcatccacgccaagcacgagtggatgaccaccgaggacatgctggcggtctggaaccgcgtgtggatccaggagaacccctggatggaggacaagacccccgtggagtcctgggaggaggtcccctacctggggaagcgggaggaccagtggtgcggcagcctcatcgggctgacgagccgcgccacctgggccaagaacatccagaccgccatcaaccaggtgcggtccctgatcggcaacgaggagtacaccgactacatgccgagcatgaagcgcttccgccgggaggaggaggaggccggcgtgctctggtga

SEQ ID NO: 9229 - RNA, 9876 nt, synthetic construct
  misc_feature 1..9876: note = derived and/or modified CDS sequence (opt1) from DENV-2__FJ850067__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccctggtgaccccgatgctccgccactccatcgagaacagctccgtcaacgtgagcctgacggccatcgccaaccaggccaccgtgctgatgggcctcgggaagggctggcccctgtccaagatggacatcggggtccccctgctcgcgatcggctgctacagccaggtgaaccccatcaccctgaccgccgccctgctcctgctggtggcccactacgccatcatcgggccgggcctccaggcgaaggccacgcgggaggcccagaagcgcgccgccgcgggcatcatgaagaaccccaccgtcgacgggatcaccgtgatcgacctggagcccatcccctacgacccgaagttcgagaagcagctgggccaggtgatgctcctgatcctgtgcgtcacccaggtgctcatgatgcggacgacctgggccctgtgcgaggccctgaccctcgccaccgggcccatctccacgctgtgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaccatcggcgagacgctgggcgagaagtggaagtcccggctcaacgccctgggcaagagcgagttccagatctacaagaagtccggcatccaggaggtcgaccgcaccctggcgaaggaggggatcaagcggggcgagaccgaccaccacgccgtgagccgcgggtccgccaagctccggtggttcgtggagcgcaacatggtcacccccgagggcaaggtggtggacctgggctgcgggcggggcgggtggagctactactgcggcgggctgaagaacgtccgcgaggtgaagggcctcacgaagggcgggccgggccacgaggagcccatccccatgtccacctacgggtggaacctggtgcggctgcagagcggcgtcgacgtgttcttcacgccgcccgagaagtgcgagaccctcctgtgcgacatcggggagagctcccccaaccccaccatcgaggccggccgcacgctgcgggtgctcaacctggtcgagaactggctgaacaacaacacccagttctgcatcaaggtgctcaacccctacatgcccagcgtgatcgagaagatggaggccctgcagcgcaagtacggcggggcgctggtccggaaccccctgtcccgcaacagcacccacgagatgtactgggtgtccaacgccaccggcaacatcgtgagctccgtcaacatgatcagccggatgctcatcaaccgcttcacgatgaagcacaagaaggccacctacgagcccgacgtggacctggggtccggcacccggaacatcgggatcgagagcgagatcccgaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtgaacggcgtcgtgcgcctcctgaccaagccctgggacgtggtccccatggtgacgcagatggcgatgaccgacaccaccccgttcgggcagcagcgggtgttcaaggagaaggtcgacacgcgcacccaggagcccaaggagggcaccaagaagctgatgaagatcaccgccgagtggctctggaaggagctgggcaagaagaagacgccccggatgtgcacccgcgaggagttcacccggaaggtgcgcagcaacgccgccctgggggccatcttcaccgacgagaacaagtggaagtccgcgcgggaggccgtggaggacggccgcttctgggagctcgtcgaccgggagcgcaacctgcacctggaggggaagtgcgagacgtgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgggaacagcctgagcggcgtggagggggagggcctccaccggctgggctacatcctgcgcgacgtcgggaagaaggagggcggggccatgtacgccgacgacaccgccggctgggacacccggatcaccctcgaggacctgaagaacgaggagatggtgacgaaccacatgaagggggagcacaagaagctggcggaggccatcttcaagctcacctaccagaacaaggtcgtgcgcgtgcagcggcccaccccgcgcggcaccgtcatggacatcatctcccggcgcgaccagcgcggcagcgggcaggtcggcacgtacgggctgaacaccttcaccaacatggaggcccagctgatccggcagatggagggcgagggcatcttcaagtccatccagcacctcaccgccacggaggagatcgccgtgcagaactggctggcgcgcgtcgggcgggagcgcctgagccggatggccatctccggcgacgactgcgtggtgaagcccatcgacgaccgcttcgccagcgccctcaccgccctgaacgacatggggaagatccggaaggacatccagcagtgggagccctcccgcggctggaacgactggacccaggtccccttctgcagccaccacttccacgagctggtgatgaaggacgggcgggtgctcgtcgtgccgtgccgcaaccaggacgagctgatcggccgggcgcgcatctcccagggcgccgggtggagcctgaaggagaccgcctgcctcggcaagtcctacgcccagatgtggaccctgatgtacttccaccggcgcgacctgcggctcgccgcgaacgccatctgcagcgccgtgccctcccactgggtccccacgagccgcaccacctggtccatccacgccaagcacgagtggatgaccacggaggacatgctggcggtgtggaaccgggtgtggatccaggagaacccctggatggaggacaagaccccggtcgagagctgggaggaggtgccctacctggggaagcgcgaggaccagtggtgcggctccctcatcgggctgaccagccgggccacctgggccaagaacatccagacggccatcaaccaggtgcgcagcctgatcggcaacgaggagtacaccgactacatgccctccatgaagcgcttccggcgcgaggaggaggaggccggcgtcctctggtga

SEQ ID NO: 9230 - RNA, 9876 nt, synthetic construct
  misc_feature 1..9876: note = derived and/or modified CDS sequence (opt1) from DENV-2__FJ850060__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaagatccgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtgctcaagatcgtccgcaacatggagaagtaccagctggccgtgacgatcatggccatctcctgcgtgccgaacgccgtcatcctgcagaacgcgtggaaggtgagctgcgccatcctcgccgccgtgtccgtcagccccctgctgctcacctccagccagcagaaggcggactggatccccctggccctgaccatcaagggcctcaaccccaccgccatcttcctgacgaccctgtcccggaccagcaagaagcgctcctggccgctcaacgaggccgtgatggccgtcggcatggtgagcatcctggcgtccagcctgctcaagaacgacatccccatgaccgggcccctggtggccggcgggctgctcacggtctgctacgtgctgaccggccggagcgccgacctggagctcgagcgcgccgccgacgtgaagtgggaggaccaggcggagatctccgggagctcccccatcctgagcatcaccatctccgaggacggcagcatgtccatcaagaacgaggaggaggagcagaccctgacgatcctcatccggaccggcctgctggtcatcagcggggtgttcccggtgtccatccccatcaccgccgccgcctggtacctctgggaggtcaagaagcagcgcgccggcgtgctgtgggacgtgcccagcccgccgcccgtcgagaaggcggagctggaggacggggcctaccggatcaagcagcgcggcatcctcgggtactcccagatcggcgccggcgtgtacaaggaggggaccttccacaccatgtggcacgtgacgcggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggcgctggagcccggcaagaacccccgcgccgtgcagaccaagcccgggatcttcaagaccaacaccggcacgatcggggccgtgagcctcgacttctcccccggcaccagcggctcccccatcgtcgaccggaaggggaaggtggtgggcctgtacgggaacggcgtcgtgacccgcagcggcgcctacgtgtccgcgatcgcccagaccgagaagtccatcgaggacaaccccgagatcgaggacgacatcttccggaagaagcgcctgacgatcatggacctccaccccggggccggcaagaccaagcggtacctgcccgccatcgtccgcgaggccatcaagcgggggctgcgcaccctgatcctcgcgccgacccgcgtggtggccgccgagatggaggaggccctgcggggcctgcccatccgctaccagacgcccgccatcaagaccgagcacaccgggcgggagatcgtcgacctcatgtgccacgcgaccttcacgatgcgcctgctgagccccgtgcgggtgccgaactacaacctcatcatcatggacgaggcccacttcaccgaccccgcctccatcgccgcccgcggctacatcagcacccgggtcgagatgggcgaggcggccgggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctgcggaagaacggcaagaaggtgatccagctgagccgcaagaccttcgactccgagtacgtgaagacgcgggccaacgactgggacttcgtcgtgaccaccgacatcagcgagatgggcgccaacttcaaggcggagcgcgtgatcgacccccggcgctgcatgaagcccgtcatcctcaccgacggggaggagcgggtgatcctggccggccccatgccggtgacgcactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtcgacgccatcgacggcgagtaccgcctgcgcggggaggcccgcaagaccttcgtggacctcatgcggcgcggcgacctgcccgtgtggctggcctacaaggtcgccgcggaggggatcaactacgccgaccggaagtggtgcttcgacggcatccgcaacaaccagatcctcgaggagaacatggaggtggagatctggaccaaggagggggagcggaagaagctgaagccgcgctggctggacgcccggatctacagcgaccccctcgccctgaaggagttcaaggagttcgcggccggccgcaagtccctgacgctcaacctgatcaccgagatgggcaagctgcccaccttcatgacccagaaggcccggaacgccctcgacaacctggccgtgctgcacacggcggaggccgggggccgcgcctacaaccacgccctcagcgagctgcccgagaccctggagaccctcctgctgctcaccctgctggccacggtcaccgggggcatcttcctcttcctgatgtccggcaaggggatcggcaagatgaccctggggatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacgtacgtcgtgatcgccatcctgaccgtggtcgcggccaccatggccaacgagatgggcttcctggagaagaccaagaaggacctcgggctgggcagcatcacgacccaggagagcgagtccaacatcctggacatcgacctccgcccggccagcgcctggaccctgtacgcggtggccaccacgttcgtgacccccatgctgcggcactccatcgagaacagctccgtcaacgtgagcctcaccgccatcgccaaccaggcgaccgtgctgatgggcctggggaagggctggcccctctccaagatggacatcggggtccccctgctggccatcggctgctacagccaggtgaacccgatcacgctcaccgccgccctgctgctcctggtggcccactacgcgatcatcgggcccggcctgcaggccaaggccacccgcgaggcccagaagcgggccgcggccggcatcatgaagaaccccaccgtcgacgggatcacggtgatcgacctcgagcccatcccgtacgaccccaagttcgagaagcagctgggccaggtgatgctgctcatcctgtgcgtcacccaggtgctgatgatgcgcaccacctgggccctctgcgaggccctgacgctggccaccgggcccatctccaccctctgggagggcaaccccgggcggttctggaacaccacgatcgcggtgagcatggccaacatcttccgcggctcctacctggccggcgccgggctcctgttcagcatcatgaagaacaccaccaacacccgccggggcacggggaacatcggcgagaccctgggcgagaagtggaagtcccgcctgaacgcgctcggcaagagcgagttccagatctacaagaagtccggcatccaggaggtcgaccggaccctggccaaggaggggatcaagcgcggcgagaccgaccaccacgccgtgagccgggggtccgccaagctgcgctggttcgtggagcggaacatggtcacgccggagggcaaggtggtggacctcggctgcgggcgcggcgggtggagctactactgcggcgggctgaagaacgtccgggaggtgaagggcctgaccaagggcgggcccggccacgaggagcccatccccatgtccacctacgggtggaacctcgtgcgcctgcagagcggcgtcgacgtgttcttcaccccgcccgagaagtgcgacacgctgctctgcgacatcggggagagctcccccaaccccaccatcgaggccggccggaccctgcgcgtgctgaacctcgtcgagaactggctgaacaacaacacccagttctgcatcaaggtgctgaacccgtacatgcccagcgtgatcgagaagatggaggcgctccagcggaagtacggcggggccctggtccgcaaccccctgtcccggaacagcacccacgagatgtactgggtgtccaacgccacgggcaacatcgtgagctccgtcaacatgatcagccgcatgctgatcaaccggttcaccatgaagcacaagaaggccacctacgagccggacgtggacctcgggtccggcacccgcaacatcgggatcgagagcgagatccccaacctggacatcatcggcaagcggatcgagaagatcaagcaggagcacgagacgtcctggcactacgaccaggaccacccctacaagacctgggcctaccacggcagctacgagaccaagcagaccgggtccgcgagctccatggtgaacggcgtcgtgcgcctgctcacgaagccctgggacgtggtcccgatggtgacccagatggccatgaccgacaccacgcccttcgggcagcagcgcgtgttcaaggagaaggtcgacacccggacccaggagcccaaggagggcaccaagaagctgatgaagatcacggccgagtggctgtggaaggagctcggcaagaagaagacgccccgcatgtgcacccgggaggagttcacccgcaaggtgcggagcaacgccgccctgggggcgatcttcacggacgagaacaagtggaagtccgcccgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggcgatctggtacatgtggctcggggcccgcttcctggagttcgaggccctgggcttcctcaacgaggaccactggttctcccgggggaacagcctgagcggcgtggagggggagggcctgcaccgcctcggctacatcctgcgggacgtcgggaagaaggagggcggggccatgtacgccgacgacaccgcgggctgggacacccgcatcacgctggaggacctcaagaacgaggagatggtgaccaaccacatgaagggggagcacaagaagctggccgaggccatcttcaagctgacctaccagaacaaggtcgtgcgggtgcagcgcccgacgccccggggcacggtcatggacatcatctcccgccgggaccagcgcggcagcgggcaggtcggcacctacgggctcaacaccttcaccaacatggaggcccagctgatccgccagatggagggcgagggcatcttcaagtccatccagcacctgacggccaccgaggagatcgcggtgcagaactggctcgcccgggtcgggcgcgagcggctgagccgcatggccatctccggcgacgactgcgtggtgaagcccatcgacgaccggttcgccagcgccctgaccgcgctcaacgacatggggaaggtccgcaaggacatccagcagtgggagccctcccggggctggaacgactggacccaggtgccgttctgcagccaccacttccacgagctggtgatgaaggacgggcgcgtcctggtggtgccctgccggaaccaggacgagctcatcggccgcgcccggatctcccagggcgccgggtggagcctgaaggagacggcctgcctgggcaagtcctacgcccagatgtggaccctcatgtacttccaccgccgggacctgcgcctggcggccaacgccatctgcagcgccgtgccgccccactgggtgccgacctcccggaccacctggagcatccacgcgaagcacgagtggatgacgaccgaggacatgctcgccgtgtggaaccgcgtctggatccaggggaacccctggatggaggacaagacccccgtggagtcctgggaggaggtgccctacctgggcaagcgggaggaccagtggtgcgggagcctgatcggcctcacctcccgcgccacgtgggccaagaacatccagaccgccatcaaccaggtccggagcctgatcggcaacgaggagtacaccgactacatgccgagcatgaagcgcttccgccgggaggaggaggaggcgggggtgctgtggtga

SEQ ID NO: 9231 - RNA, 9876 nt, synthetic construct
  misc_feature 1..9876: note = derived and/or modified CDS sequence (opt1) from DENV-2__FJ850061__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgccacgaccatgcgcggcgccaagcggatggccatcctgggggacaccgcctgggacttcggcagcctcggcggggtgttcacctccatcgggaaggcgctccaccaggtcttcggggccatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggcgatggtgcaggccgactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggcgggcaagcggagcctgcgcccgcagcccaccgagctgaagtactcctggaagacgtggggcaaggccaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgcgatcaaggacaaccgggccgtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgcggggcccgtgtcccagcacaactaccgcccgggctaccacacgcagaccgccgggccctggcacctcggcaagctggagatggacttcgacctgtgcgaggggaccaccgtcgtggtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcatcggcacgaagcacgccatcctcctggtcgccgtgagcttcgtgaccctgatcaccgggaacatgtccttccgggacctcggccgcgtcatggtgatggtgggggccaccatgacggacgacatcggcatgggcgtcacctacctggccctgctcgcggccttcaaggtgcgccccaccttcgccgccgggctgctgctccggaagctgaccagcaaggagctgatgatggccacgatcggcatcgcgctcctgtcccagagcaccatccccgagaccatcctggagctcaccgacgccctggccctggggatgatggtgctcaagatcgtccgcaacatggagaagtaccagctggccgtgacgatcatggccatctcctgcgtgccgaacgcggtcatcctgcagaacgcctggaaggtgagctgcaccatcctcgccgccgtgtccgtcagccccctgctgctcacctccagccagcagaaggcggactggatccccctggccctgaccatcaagggcctcaaccccacggccatcttcctgaccaccctgtcccggaccagcaagaagcgctcctggccgctcaacgaggccatcatggccgtgggcatggtcagcatcctggcgtccagcctgctcaagaacgacatccccatgacggggcccctggtggccggcgggctgctcaccgtgtgctacgtcctgaccggccggagcgccgacctggagctcgagcgcgccgccgacgtgaagtgggaggaccaggcggagatctccgggagctcccccatcctgagcatcaccatctccgaggacggcagcatgtccatcaagaacgaggaggaggagcagacgctgaccatcctcatccggaccggcctgctggtgatcagcggggtcttcccggtgtccatccccatcaccgccgccgcctggtacctctgggaggtgaagaagcagcgcgccggcgtcctgtgggacgtgcccagcccgccgcccgtggagaaggcggagctggaggacggggcctaccggatcaagcagcgcggcatcctcgggtactcccagatcggcgccggcgtctacaaggaggggaccttccacacgatgtggcacgtgacccggggcgccgtgctgatgcaccgcgggaagcggatcgagcccagctgggccgacgtcaagaaggacctgatctcctacggcgggggctggaagctcgagggcgagtggaaggagggggaggaggtccaggtgctggcgctggagcccggcaagaacccccgcgccgtccagaccaagcccgggatcttcaagaccaacacgggcaccatcggggccgtgagcctcgacttctcccccggcaccagcggctcccccatcgtggaccggaaggggaaggtcgtgggcctgtacgggaacggcgtggtcacccgcagcggcgcctacgtgtccgcgatcgcccagacggagaagtccatcgaggacaaccccgagatcgaggacgacatcttccggaagaagcgcctgaccatcatggacctccaccccggggccggcaagaccaagcggtacctgcccgccatcgtgcgcgaggccatcaagcgggggctgcgcaccctgatcctcgcgccgacgcgcgtcgtggccgccgagatggaggaggccctgcggggcctgcccatccgctaccagacccccgccatcaagaccgagcacaccgggcgggagatcgtggacctcatgtgccacgcgacgttcaccatgcgcctgctgagccccgtccgggtgccgaactacaacctcatcatcatggacgaggcccacttcaccgaccccgcctccatcgccgcccgcggctacatcagcacccgggtggagatgggcgaggcggccgggatcttcatgacggccacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggcggggaacgacatcgccgcctgcctgcggaagaacggcaagaaggtcatccagctgagccgcaagacgttcgactccgagtacgtgaagacccgggccaacgactgggacttcgtggtcaccaccgacatcagcgagatgggcgccaacttcaaggcggagcgcgtgatcgacccccggcgctgcatgaagcccgtgatcctcacggacggggaggagcgggtcatcctggccggccccatgccggtgacccactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtggacgccatcgacggcgagtaccgcctgcgcggggaggcccgcaagaccttcgtcgacctcatgcggcgcggcgacctgcccgtgtggctggcctacaaggtggccgcggaggggatcaactacgccgaccggaagtggtgcttcgacggcatcaagaacaaccagatcctcgaggagaacatggaggtcgagatctggacgaaggagggggagcgcaagaagctgaagccgcggtggctggacgcccgcatctacagcgaccccctcgccctgaaggagttcaaggagttcgcggccggccggaagtccctgaccctcaacctgatcaccgagatgggccgcctgcccaccttcatgacgcagaaggcccggaacgccctcgacaacctggccgtgctgcacaccgcggaggccgggggccgcgcctacaaccacgccctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgcgagcatcctcctgtggtacgcccagatccagccgcactggatcgccgcctccatcatcctggagttcttcctcatcgtcctgctgatccccgagcccgagaagcagcggacgccccaggacaaccagctcacctacgtggtcatcgccatcctgaccgtggtggcggccaccatggccaacgagatgggcttcctggagaagacgaagaaggacctcgggctgggcagcatcaccacccaggagagcgagtccaacatcctggacatcgacctccgcccggccagcgcctggaccctgtacgcggtcgccacgaccttcgtgacccccatgctgcggcactccatcgagaacagctccgtgaacgtcagcctcaccgccatcgccaaccaggcgacggtgctgatgggcctggggaagggctggcccctctccaagatggacatcggggtgcccctgctggccatcggctgctacagccaggtcaagccgatcaccttcaccgccgccctcctgctgctcgtggcccactacgcgatcatcgggcccggcctgcaggccaaggcgccccgcgaggcccagaagcgggccgcggccggcatcatgaagaaccccaccgtggacgggatcacggtcatcgacctggagccgatcccctacgaccccaagttcgagaagcagctcggccaggtgatgctgctgatcctctgcgtgacccaggtcctgatgatgcgcaccacctgggccctgtgcgaggccctcacgctggccaccgggcccatctccaccctgtgggagggcaacccggggcggttctggaacaccacgatcgcggtgagcatggccaacatcttccgcggctcctacctcgccggcgccgggctgctgttcagcatcatgaagaacaccaccaacacccgccggggcacggggaacatcggcgagaccctcggcgagaagtggaagtcccgcctgaacgcgctgggcaagagcgagttccagatctacaagaagtccggcatccaggaggtggaccggaccctcgccaaggaggggatcaagcgcggcgagaccgaccaccacgccgtcagccgggggtccgccaagctgcgctggttcgtggagcggaacatggtgacgcccgagggcaaggtcgtggacctgggctgcgggcgcggcgggtggagctactactgcggcgggctcaagaacgtgcgggaggtcaagggcctgaccaagggcgggcccggccacgaggagcccatcccgatgtccacctacgggtggaacctggtgcgcctccagagcggcgtggacgtcttcttcacgccgcccgagaagtgcgacacgctgctgtgcgacatcggggagagctcccccaacccgaccatcgaggccggccggaccctccgcgtgctgaacctggtggagaactggctcaacaacaacacccagttctgcatcaaggtcctgaacccctacatgcccagcgtgatcgagaagatggaggcgctgcagcggaagtacggcggggccctcgtgcgcaacccgctgtcccggaacagcacccacgagatgtactgggtctccaacgccacgggcaacatcgtgagctccgtgaacatgatcagccgcatgctgatcaaccggttcaccatgaagcacaagaaggccacctacgagcccgacgtcgacctggggtccggcacccgcaacatcgggatcgagagcgaggtgcccaacctcgacatcatcggcaagcggatcgagaagatcaagcaggagcacgagacgtcctggcactacgaccaggaccacccctacaagacctgggcctaccacggcagctacgagaccaagcagaccgggtccgcgagctccatggtgaacggcgtcgtgcgcctgctgacgaagccgtgggacgtggtccccatggtgacccagatggccatgaccgacaccacgcccttcgggcagcagcgcgtgttcaaggagaaggtcgacacccggacccaggagcccaaggagggcaccaagaagctcatgaagatcacggccgagtggctgtggaaggagctgggcaagaagaagaccccgcgcatgtgcacccgggaggagttcacccgcaaggtgcggagcaacgccgccctcggggcgatcttcacggacgagaacaagtggaagtccgcccgcgaggccgtggaggacggccggttctgggagctggtcgaccgcgagcggaacctgcacctcgaggggaagtgcgagacctgcgtgtacaacatgatgggcaagcgcgagaagaagctgggggagttcggcaaggccaagggcagccgggcgatctggtacatgtggctgggggcccgcttcctcgagttcgaggccctgggcttcctgaacgaggaccactggttctcccgggggaacagcctcagcggcgtggagggggagggcctgcaccgcctgggctacatcctccgggacgtcgggaagaaggagggcggggccatgtacgccgacgacaccgcgggctgggacacccgcatcacgctggaggacctgaagaacgaggagatggtgaccaaccacatgaagggggagcacaagaagctcgccgaggccatcttcaagctgacctaccagaacaaggtcgtgcgggtgcagcgccccacgccccggggcacggtcatggacatcatctcccgccgggaccagcgcggcagcggccaggtgggcacctacgggctgaacaccttcaccaacatggaggcccagctcatccgccagatggagggcgagggcatcttcaagtccatccagcacctgacggccaccgaggagatcgcggtgcagaactggctggcccgggtcgggcgcgagcggctcagccgcatggccatctccggcgacgactgcgtggtgaagcccatcgacgaccggttcgccagcgccctgaccgcgctgaacgacatggggaaggtccgcaaggacatccagcagtgggagccgtcccggggctggaacgactggacccaggtgcccttctgcagccaccacttccacgagctcgtgatgaaggacgggcgcgtcctggtggtgccctgccggaaccaggacgagctgatcggccgcgcccggatctcccagggcgccgggtggagcctcaaggagacggcctgcctgggcaagtcctacgcccagatgtggaccctgatgtacttccaccgccgggacctccgcctggcggccaacgccatctgcagcgccgtgccgccccactgggtgcccacctcccggaccacctggagcatccacgcgaagcacgagtggatgacgaccgaggacatgctggccgtgtggaaccgcgtctggatccaggagaacccctggatggaggacaagacccccgtggagtcctgggaggaggtgccctacctcgggaagcgggaggaccagtggtgcggcagcctgatcgggctgacctcccgcgccacgtgggccaagaacatccagaccgccatcaaccaggtccggagcctcatcggcaacgaggagtacaccgactacatgcccagcatgaagcgcttccgccgggaggaggaggaggcgggcgtgctgtggtga

SEQ ID NO: 9232 - RNA, 9876 nt, synthetic construct
  misc_feature 1..9876: note = derived and/or modified CDS sequence (opt1) from DENV-2__FJ744709__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcggtgctggcctacaccatcgggaccacgcacttccagaaggccctcatcttcatcctgctgaccgccgtcgcgcccagcatgaccatgcggtgcatcggcatcagcaaccgcgacttcgtggagggcgtgagcgggggcagctgggtcgacatcgtgctcgagcacgggagctgcgtgaccacgatggccaagaacaagcccaccctggacttcgagctgatcaagaccgaggccaagcagcccgccaccctccggaagtactgcatcgaggccaagctgacgaacaccaccaccgagtcccgctgcccgacgcagggcgagcccagcctgaacgaggagcaggacaagcggttcatctgcaagcactccatggtcgaccgcggctgggggaacggctgcgggctgttcggcaagggcgggatcgtgacctgcgcgatgttcacgtgcaagaagaacatggagggcaaggtggtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccggaccggcctcgacttcaacgagatggtgctgctgcagatggaggacaaggcctggctcgtgcaccgccagtggttcctggacctgcccctcccctggctgccgggggccgacacccagggcagcaactggatccagaaggagacgctggtcaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtcatccgggtgcagtacgagggcgacggctccccctgcaagatccccttcgagatcaccgacctggagaagcgccacgtgctcgggcggctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagacgaccatgcgcggcgccaagcgcatggccatcctgggggacaccgcctgggacttcggcagcctcggcggggtgttcacctccatcgggaaggccctccaccaggtgttcggggcgatctacggcgccgccttcagcggggtctcctggacgatgaagatcctgatcggcgtgatcatcacctggatcgggatgaacagccggtccaccagcctgtccgtgagcctggtcctcgtgggcgtggtcaccctgtacctgggggccgtggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccgcagcgtcacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccggccgggctaccacacgcagaccgcggggccctggcacctcggcaagctggagatggacttcgacttctgcgaggggaccaccgtcgtggtgacggaggactgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtcaacagcctggtgaccgccgggcacggccagatcgacaacttctccctcggcgtgctggggatggccctgttcctcgaggagatgctgcgcacccggatcggcacgaagcacgcgatcctgctcgtcgccgtgagcttcgtgaccctgatcaccgggaacatgtccttccgcgacctgggccgggtcatggtgatggtgggggccaccatgacggacgacatcggcatgggcgtcacctacctcgccctgctggccgcgttcaaggtgcgccccaccttcgccgccgggctcctgctgcgcaagctcaccagcaaggagctgatgatggccacgatcggcatcgccctgctctcccagagcaccatccccgagaccatcctggagctgaccgacgcgctcgccctggggatgatggtgctgaagatcgtccggaacatggagaagtaccagctcgccgtgacgatcatggccatctcctgcgtgccgaacgccgtcatcctgcagaacgcgtggaaggtgagctgcaccatcctggccgccgtctccgtgagccccctcctgctgacctccagccagcagaaggccgactggatccccctcgcgctgaccatcaagggcctgaaccccacggccatcttcctcaccaccctgtcccgcaccagcaagaagcggtcctggccgctgaacgaggccatcatggccgtgggcatggtcagcatcctcgcctccagcctgctgaagaacgacatccccatgacggggcccctcgtggcgggcgggctgctgaccgtgtgctacgtcctcaccggccgcagcgccgacctggagctggagcgggccgccgacgtgaagtgggaggaccaggccgagatctccgggagctcccccatcctcagcatcaccatctccgaggacggcagcatgtccatcaagaacgaggaggaggagcagacgctgaccatcctgatccgcaccggcctcctggtgatcagcgggatcttcccggtctccatccccatcaccgcggccgcctggtacctgtgggaggtgaagaagcagcgggccggcgtgctctgggacgtccccagcccgccgcccgtggagaaggccgagctggaggacggggcgtaccgcatcaagcagcggggcatcctggggtactcccagatcggcgccggcgtgtacaaggaggggaccttccacacgatgtggcacgtcacccgcggcgccgtgctcatgcaccgggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagaccaagcccgggatcttcaagaccaacacgggcaccatcggggccgtcagcctggacttctcccccggcaccagcggctcccccatcgtggaccgcaaggggaaggtggtcggcctctacgggaacggcgtggtgacccggagcggcgcctacgtctccgccatcgcgcagacggagaagtccatcgaggacaaccccgagatcgaggacgacatcttccgcaagaagcggctgaccatcatggacctgcaccccggggccggcaagaccaagcgctacctccccgccatcgtgcgggaggccatcaagcgcgggctgcggaccctgatcctggccccgacgcgcgtggtcgcggccgagatggaggaggccctccgcggcctgcccatccggtaccagacccccgccatcaagaccgagcacaccgggcgcgagatcgtggacctgatgtgccacgccacgttcaccatgcggctcctgagccccgtgcgcgtcccgaactacaacctgatcatcatggacgaggcgcacttcaccgaccccgcctccatcgccgcccggggctacatcagcacccgcgtggagatgggcgaggccgcggggatcttcatgacggccacgccgcccggctcccgggacccgttcccccagagcaacgcccccatcatggacgaggagcgcgagatccccgagcggtcctggaacagcgggcacgagtgggtgaccgacttcaagggcaagaccgtctggttcgtgccgtccatcaaggccgggaacgacatcgcggcctgcctccgcaagaacggcaagaaggtgatccagctgagccggaagacgttcgactccgagtacgtcaagacccgcgccaacgactgggacttcgtggtgaccaccgacatcagcgagatgggcgccaacttcaaggccgagcgggtcatcgacccccgccggtgcatgaagcccgtgatcctgacggacggggaggagcgcgtgatcctcgcgggccccatgccggtcacccactccagcgccgcccagcggcgcgggcggatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgcgagaaggtggacgcgatcgacggcgagtaccggctgcgcggggaggcccggaagaccttcgtggacctgatgcgccggggcgacctccccgtctggctggcctacaaggtggccgccgaggggatcaactacacggaccgcaagtggtgcttcgacggcatcaagaacaaccagatcctggaggagaacatggaggtggagatctggaccaaggagggggagcggaagaagctcaagccgcgctggctggacgcgcggatctacagcgaccccctggccctcaaggagttcaaggagttcgccgccggccgcaagtccctgaccctgaacctcatcaccgagatgggccggctgcccacgttcatgacccagaaggcgcgcaacgccctggacaacctcgccgtcctgcacaccgccgaggccgggggccgggcgtacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggccagcatcctgctctggtacgcccagatccagccgcactggatcgcggcctccatcatcctggagttcttcctgatcgtcctcctgatccccgagcccgagaagcagcgcacgccccaggacaaccagctgacctacgtggtgatcgccatcctcaccgtcgtggccgccacgatggcgaacgagatgggcttcctggagaagaccaagaaggacctggggctcggcagcatcaccacccaggagagcgagtccaacatcctggacatcgacctgcggccggccagcgcctggacgctctacgccgtggccaccaccttcgtcacccccatgctgcgccactccatcgagaacagctccgtgaacgtgagcctgacggcgatcgccaaccaggccaccgtcctcatgggcctggggaagggctggcccctgtccaagatggacatcggggtgcccctcctggccatcggctgctacagccaggtgaacccgatcaccctgaccgcggccctcctgctgctcgtcgcccactacgccatcatcgggcccggcctgcaggccaaggcgacgcgggaggcccagaagcgcgccgccgccggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcggacgacctgggcgctgtgcgaggccctcaccctggccaccgggcccatctccacgctgtgggagggcaaccccgggcgcttctggaacaccaccatcgccgtcagcatggccaacatcttccggggctcctacctcgcgggcgccgggctgctgttcagcatcatgaagaacaccacgtccacccgccgcggcaccgggaacatcggcgagaccctcggcgagaagtggaagtcccggctgaacgccctggggaagtccgagttccagatctacaagaagtccggcatccaggaggtggaccgcacgctcgccaaggaggggatcaagcggggcgagaccgaccaccacgcggtgtcccgcgggagcgccaagctgcggtggttcgtcgagcgcaacatggtgaccccggagggcaaggtggtcgacctgggctgcgggcggggcgggtggtcctactactgcggcgggctcaagaacgtgcgcgaggtgaagggcctgaccaagggcgggcccggccacgaggagcccatccccatgagcacgtacgggtggaacctggtccggctccagagcggcgtggacgtgttcttcaccccgcccgagaagtgcgacaccctgctgtgcgacatcggggagtccagccccaaccccaccatcgaggccggccgcaccctccgggtcctgaacctggtggagaactggctcaacaacaacacgcagttctgcatcaaggtgctgaacccgtacatgccctccgtcatcgagaagatggaggccctgcagcgccagtacggcggggccctcgtgcggaaccccctgagccgcaactccacccacgagatgtactgggtgagcaacgcgaccggcaacatcgtctccagcgtgaacatgatctcccggatgctgatcaaccgcttcaccatgaagcacaagaaggccacgtacgagccggacgtggacctggggagcggcacccggaacatcgggatcgagtccgagatccccaacctcgacatcatcggcaagcgcatcgagaagatcaagcaggagcacgagatcagctggcactacgaccaggaccacccctacaagacctgggcctaccacggctcctacgagaccaagcagacggggagcgcctccagcatggtcaacggcgtggtgcggctgctgaccaagccctgggacgtcgtgccgatggtgacccagatggccatgaccgacacgacccccttcgggcagcagcgcgtcttcaaggagaaggtggacacccgcacccaggagcccaaggagggcacgaagaagctcatgaagatcaccgcggagtggctgtggaaggagctgggccggaagaagacgccccgcatgtgcacccgggaggagttcacgcgcaaggtgcggtccaacgccgccctcggggccatcttcaccgacgagaacaagtggaagtccgcccgcgaggcggtcgaggacggccggttctgggagctggtggaccgcgagcggaacctgcacctcgaggggaagtgcgagacctgcgtgtacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggagaacagcctctccggggtcgagggcgaggggctgcaccgcctgggctacatcctccgggacgtgggcaagaaggagggcggcgccatgtacgccgacgacaccgccgggtgggacacgcgcatcaccctggaggacctgaagaacgaggagatggtcaccaaccacatgaagggcgagcacaagaagctcgccgaggcgatcttcaagctgacctaccagaacaaggtggtgcgggtccagcgcccgacgccccgggggaccgtgatggacatcatcagccgccgggaccagcgcggctccggccaggtggggacctacggcctgaacaccttcacgaacatggaggcccagctcatccgccagatggagggggagggcatcttcaagagcatccagcacctgaccgccaccgaggagatcgccgtccagaactggctggcccgggtgggccgcgagcggctctcccgcatggcgatcagcggggacgactgcgtggtcaagcccatcgacgaccggttcgcctccgccctgaccgccctgaacgacatgggcaaggtgcgcaaggacatccagcagtgggagcccagccgggggtggaacgactggacccaggtgccgttctgctcccaccacttccacgagctcgtcatgaaggacggccgcgtgctggtggtcccctgccggaaccaggacgagctgatcgggcgcgcccggatcagccagggcgcgggctggtccctcaaggagaccgcctgcctgggcaagagctacgcccagatgtggaccctgatgtacttccaccgccgggacctccgcctggccgccaacgcgatctgctccgccgtgcccagccactgggtgcccacctcccggaccacgtggagcatccacgccaagcacgagtggatgaccaccgaggacatgctggccgtctggaaccgcgtgtggatccaggagaacccgtggatggaggacaagacccccgtggagtcctgggaggaggtcccctacctcggcaagcgggaggaccagtggtgcgggagcctgatcggcctgacgagccgcgcgacctgggccaagaacatccagaccgccatcaaccaggtgcggtccctcatcgggaacgaggagtacaccgactacatgcccagcatgaagcgcttccgccgggaggaggaggaggccggcgtgctgtggtga

SEQ ID NO: 9233 - RNA, 9876 nt, synthetic construct
  misc_feature 1..9876: note = derived and/or modified CDS sequence (opt1) from DENV-2__FJ744708__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcggagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatgggcctggggaagggctggcccctgtccaagatggacatcggggtgcccctcctggcgatcggctgctacagccaggtgaacccgatcaccctgaccgccgccctcctgctgctcgtcgcccactacgccatcatcgggcccggcctgcaggcgaaggccacccgcgaggcccagaagcgggccgccgcgggcatcatgaagaaccccacggtggacgggatcaccgtgatcgacctggagcccatcccgtacgaccccaagttcgagaagcagctcggccaggtcatgctgctgatcctctgcgtgacccaggtgctgatgatgcgcaccacgtgggccctgtgcgaggccctcaccctggccaccgggcccatctccaccctgtgggagggcaaccccgggcggttctggaacacgaccatcgccgtcagcatggtgaacatcttctccggcagctacctcgcgggcgccgggctgcacgtgccgctgcgcaagaacaccctccgcacccggcgcggcacggggaacaccggcgagaccctgggcgagaagtggaagtcccggctgaacgccctcggcaagagcgagttccagatctacaagaagtccggcatccaggaggtcgaccgcaccctggccaaggaggggatcaagcggggcgagacggaccaccacgcggtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggcccggccacgaggagcccatcccgatgtccacctacgggtggaacctcgtgcggctgcagagcggcgtcgacgtgttcttcacgccgcccgagaagtgcgacaccctgctctgcgacatcggggagagctcccccaacccgaccatcgaggccggccgcaccctgcgggtgctgaacctcgtcgagaactggctgaacaacaacacccagttctgcatcaaggtgctgaacccctacatgcccagcgtgatcgagaagatggaggccctccagcgccagtacggcggggccctggtccggaacccgctgtcccgcaacagcacgcacgagatgtactgggtgtccaacgcgaccggcaacatcgtgagctccgtcaacatgatcagccggatgctgatcaaccgcttcaccatgaagcacaagaaggccacctacgagcccgacgtggacctcgggtccggcacgcggaacatcgggatcgagagcgagatccccaacctggacatcatcggcaagcgcatcgagaagatcaagcaggagcacgagatctcctggcactacgaccaggaccacccctacaagacctgggcctaccacggcagctacgagaccaagcagaccgggtccgccagctccatggtgaacggcgtcgtgcgcctgctcacgaagccgtgggacgtggtccccatggtgacccagatggccatgaccgacaccacgcccttcgggcagcagcgggtgttcaaggagaaggtcgacacccgcacccaggagcccaaggagggcaccaagaagctgatgaagatcacggcggagtggctgtggaaggagctcggcaagaagaagaccccgcggatgtgcacccgcgaggagttcaccaagaaggtgcggagcaacgccgccctgggggccatcttcacggacgagaacaagtggaagtccgcccgcgaggcggtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggccatctggtacatgtggctcggggcccgcttcctggagttcgaggcgctgggcttcctcaacgaggaccactggttctcccgggggaacagcctgagcggcgtcgagggggagggcctgcaccgcctcggctacatcctgcgggacgtggggaagaaggagggcggggccatgtacgccgacgacaccgccggctgggacacccgcatcacgctggaggacctcaagaacgaggagatggtgaccaaccacatgaagggggagcacaagaagctggccgaggcgatcttcaagctgacctaccagaacaaggtcgtgcgggtgcagcgccccacgccccggggcacggtcatggacatcatctcccgccgggaccagcgcggcagcgggcaggtcggcacctacgggctcaacaccttcaccaacatggaggcccagctgatccgccagatggagggcgagggcatcttcaagtccatccagcacctgacggccaccgaggagatcgccgtgcagaactggctcgcccgggtcgggcgcgagcggctgagccgcatggcgatctccggcgacgactgcgtggtgaagcccatcgacgaccggttcgccagcgccctgaccgccctcaacgacatggggaaggtccgcaaggacatccagcagtgggagccgtcccggggctggaacgactggacccaggtgcccttctgcagccaccacttccacgagctggtgatgaaggacgggcgcgtcctggtggtgccctgccggaaccaggacgagctcatcggccgcgcccggatctcccagggcgcggggtggagcctgaaggagacggcctgcctgggcaagtcctacgcccagatgtggaccctcatgtacttccaccgccgggacctgcgcctggccgccaacgcgatctgcagcgccgtcccctcccactgggtgccgaccagccggaccacctggtccatccacgccaagcacgagtggatgacgaccgaggacatgctcgccgtgtggaaccgcgtctggatccaggagaacccctggatggaggacaagacccccgtggagagctgggaggaggtgccctacctggggaagcgggaggaccagtggtgcggctccctgatcgggctcaccagccgcgcgacgtgggccaagaacatccagaccgccatcaaccaggtccggagcctgatcggcaacgaggagtacaccgactacatgccgtccatgaagcgcttccgccgggaggaggaggaggccggcgtgctgtggtga

SEQ ID NO: 9234 - RNA, 9876 nt, synthetic construct
  misc_feature 1..9876: note = derived and/or modified CDS sequence (opt1) from DENV-2__FJ810418__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcaagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcgtgatcacctggatcgggatgaacagccgctccaccagcctgtccgtgagcctggtcctcgtgggcgtggtcaccctgtacctgggggccgtggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatggtgatccccaagaacttcgccgggcccgtctcccagcacaactaccgcccgggctaccacacgcagaccgcggggccctggcacctcggcaagctggagatggacttcgacttctgcgaggggaccaccgtggtggtcacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacccgcatcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtcctgaagatcgtgcgcaacatggagaagtaccagctcgccgtgacgatcatggccatctcctgcgtcccgaacgccgtgatcctgcagaacgcgtggaaggtcagctgcaccatcctggccgccgtgtccgtgagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtcggcatggtgagcatcctcgcctccagcctgctgaagaacgacatccccatgacggggcccctcgtggcgggcgggctgctgaccgtctgctacgtgctcaccggccggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtcatcagcggggtgttcccggtgtccatccccatcaccgcggccgcctggtacctgtgggaggtcaagaagcagcgcgccggcgtgctctgggacgtgcccagcccgccgcccgtcgagaaggccgagctggaggacggggcgtaccggatcaagcagcgcggcatcctggggtactcccagatcggcgccggcgtgtacaaggaggggaccttccacacgatgtggcacgtgacccggggcgccgtcctcatgcaccgcgggaagcggatcgagcccagctgggccgacgtgaagaaggacctgatctcctacggcgggggctggaagctggagggcgagtggaaggagggggaggaggtgcaggtcctcgccctggagcccggcaagaacccccgcgcggtgcagaccaagcccgggatcttcaagaccaacacgggcaccatcggggccgtgagcctggacttctcccccggcaccagcggctcccccatcgtcgaccggaaggggaaggtggtgggcctctacgggaacggcgtcgtgacccgcagcggcgcctacgtgtccgccatcgcgcagacggagaagtccatcgaggacaaccccgagatcgaggacgacatcttccggaagaagcgcctgaccatcatggacctgcaccccggggccggcaagaccaagcggtacctccccgccatcgtccgcgaggccatcaagcgggggctgcgcaccctgatcctggccccgacgcgcgtggtggcggccgagatggaggaggccctccggggcctgcccatccgctaccagacccccgccatcaagaccgagcacaccgggcgggagatcgtcgacctgatgtgccacgccacgttcaccatgcgcctcctgagccccgtgcgggtgccgaactacaacctgatcatcatggacgaggcgcacttcaccgaccccgcctccatcgccgcccgcggctacatcagcacccgggtcgagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggccgggaacgacatcgcggcctgcctccggaagaacggcaagaaggtgatccagctgagccgcaagacgttcgactccgagtacgtgaagacccgggccaacgactgggacttcgtcgtgaccaccgacatcagcgagatgggcgccaacttcaaggccgagcgcgtgatcgacccccggcgctgcatgaagcccgtcatcctgacggacggggaggagcgggtgatcctcgcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtcgacgcgatcgacggcgagtaccgcctgcgcggggaggcccgcaagaccttcgtggacctgatgcggcgcggcgacctccccgtgtggctggcctacaaggtcgccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtgctcctgatccccgagcccgagaagcagcggacgccccaggacaaccagctgacctacgtcgtgatcgccatcctcaccgtggtcgccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtgacccccatgctgcggcactccatcgagaacagctccgtcaacgtgagcctgaccgccatcgccaaccaggccacggtgctcatgggcctggggaagggctggcccctgtccaagatggacatcggggtccccctcctggcgatcggctgctacagccaggtgaacccgatcaccctgaccgccgccctcctgctgctcgtggcccactacgccatcatcgggcccggcctgcaggcgaaggccacccgcgaggcccagaagcgggccgccgcgggcatcatgaagaaccccacggtcgacgggatcaccgtgatcgacctggagcccatcccgtacgaccccaagttcgagaagcagctcggccaggtgatgctgctgatcctctgcgtcacccaggtgctgatgatgcgcaccacgtgggccctgtgcgaggccctcaccctggccaccgggcccatctccaccctgtgggagggcaaccccgggcggttctggaacacgaccatcgccgtgagcatggcgaacatcttccgcggctcctacctcgccggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtcgaccggaccctcgcgaaggaggggatcaagcgcggcgagacggaccaccacgccgtgtcccgggggagcgccaagctgcgctggttcgtggagcggaacatggtcaccccggagggcaaggtggtggacctgggctgcgggcgcggcgggtggtcctactactgcggcgggctcaagaacgtccgggaggtgaagggcctgaccaagggcgggcccggccacgaggagcccatccccatgagcacctacgggtggaacctggtgcgcctccagagcggcgtcgacgtgttcttcacgccgcccgagaagtgcgacaccctgctgtgcgacatcggggagtccagccccaaccccaccatcgaggccggccggaccctccgcgtgctgaacctggtcgagaactggctcaacaacaacacccagttctgcatcaaggtgctgaacccgtacatgccctccgtgatcgagaagatggaggccctgcagcggcagtacggcggggcgctcgtccgcaaccccctgagccggaactccacgcacgagatgtactgggtgagcaacgccaccggcaacatcgtgtccagcgtcaacatgatctcccgcatgctgatcaaccggttcaccatgaagcacaagaaggccacctacgagccggacgtggacctggggagcggcacgcgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagaccgggagcgcctccagcatggtgaacggcgtcgtgcgcctgctgacgaagccctgggacgtggtcccgatggtgacccagatggcgatgaccgacaccacgcccttcgggcagcagcgcgtgttcaaggagaaggtcgacacccggacccaggagcccaaggagggcaccaagaagctcatgaagatcacggccgagtggctgtggaaggagctgggcaagaagaagacgccccgcatgtgcacccgggtggagttcaccaagaaggtgcgctccaacgccgccctcggggccatcttcacggacgagaacaagtggaagtccgcgcgggaggccgtcgaggacggccgcttctgggagctggtggaccgggagcgcaacctgcacctcgaggggaagtgcgagacctgcgtctacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtggagggggagggcctgcaccggctgggctacatcctccgcgacgtggggaagaaggagggcggggccatgtacgccgacgacaccgccggctgggacacccggatcacgctggaggacctgaagaacgaggagatggtcaccaaccacatgaagggggagcacaagaagctcgcggaggccatcttcaagctgacctaccagaacaaggtggtgcgcgtccagcggccgacgccccgcggcacggtgatggacatcatcagccggcgcgaccagcggggctccgggcaggtcggcacctacgggctgaacaccttcaccaacatggaggcccagctcatccgccagatggagggcgagggcatcttcaagagcatccagcacctgacggccaccgaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagacggcctgcctgggcaagagctacgcccagatgtggaccctgatgtacttccaccggcgcgacctccggctggccgcgaacgccatctgctccgccgtgcccagccactgggtgcccacctcccgcaccacctggagcatccacgccaagcacgagtggatgacgaccgaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacgtgggccaagaacatccagaccgccatcaaccaggtgcgctccctcatcggcaacgaggagtacaccgactacatgcccagcatgaagcggttccgccgcgaggaggaggaggccggcgtgctgtggtga

SEQ ID NO: 9235 - RNA, 9876 nt, synthetic construct
  misc_feature 1..9876: note = derived and/or modified CDS sequence (opt1) from DENV-2__FJ639835__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatggtgatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcatcggcacgaagcacgcgatcctgctcgtcgccgtgagcttcgtgaccctgatcaccgggaacatgtccttccgggacctgggccgcgtcatggtgatggtgggggccaccatgacggacgacatcggcatgggcgtcacctacctcgccctgctggccgcgttcaaggtgcgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtccgcaacatggagaagtaccagctcgccgtgacgatcatggccatctcctgcgtgccgaacgccgtcatcctgcagaacgcgtggaaggtgagctgcaccatcctggccgccgtctccgtgagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtcagcatcctcgcctccagcctgctgaagaacgacatccccatgacggggcccctcgtggcgggcgggctgctgaccgtgtgctacgtcctcaccggccggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtcttcccggtgtccatccccatcaccgcggccgcctggtacctgtgggaggtgaagaagcagcgcgccggcgtcctctgggacgtgcccagcccgccgcccgtggagaaggccgagctggaggacggggcgtaccggatcaagcagcgcggcatcctggggtactcccagatcggcgccggcgtctacaaggaggggaccttccacacgatgtggcacgtgacccggggcgccgtgctcatgcaccgcgggaagcggatcgagcccagctgggccgacgtcaagaaggacctgatctcctacggcgggggctggaagctggagggcgagtggaaggagggggaggaggtccaggtgctcgccctggagcccggcaagaacccccgcgcggtccagaccaagcccgggatcttcaagaccaacacgggcaccatcggggccgtgagcctggacttctcccccggcaccagcggctcccccatcgtggaccggaaggggaaggtcgtgggcctctacgggaacggcgtggtcacccgcagcggcgcctacgtgtccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtcgtggcggccgagatggaggaggccctccggggcctgcccatccgctaccagacccccgccatcaagaccgagcacaccgggcgggagatcgtggacctgatgtgccacgccacgttcaccatgcgcctcctgagccccgtccgggtgccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgcggcctgcctccggaagaacggcaagaaggtcatccagctgagccgcaagacgttcgactccgagtacgtgaagacccgggccaacgactgggacttcgtggtcaccaccgacatcagcgagatgggcgccaacttcaaggccgagcgcgtgatcgacccccggcgctgcatgaagcccgtgatcctgacggacggggaggagcgggtcatcctcgcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtcgacctgatgcggcgcggcgacctccccgtgtggctggcctacaaggtggccgccgaggggatcaactacgcggaccggaagtggtgcttcgacggcatcaagaacaaccagatcctggaggagaacatggaggtcgagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtgctgcacaccgccgaggccggcgggcgcgcctacaaccacgccctgagcgagctccccgagaccctggagaccctgctcctgctgacgctcctggccaccgtcaccggcgggatcttcctgttcctcatgtccggcaagagcatcgggaagatgaccctggggatgtgctgcatcatcaccgcctccatcctgctctggcacgcgcagatccagccgcactggatcgccgccagcatcatcctggagttcttcctgatcgtgctcctgatccccgagcccgagaagcagcggacgccccaggacaaccagctgacctacgtggtcatcgccatcctcaccgtggtggccgcgaccatggccaacgagatggggttcctggagaagacgaagaaggacctgggcctcgggagcatcaccacccaggagtccgagagcaacatcctggacatcgacctgcgcccggcctccgcctggaccctctacgccgtcgcgacgaccttcgtgacccccatgctgcggcacagcatcgagaactccagcgtgaacgtctccctgaccgccatcgccaaccaggccacggtgctcatgggcctgggcaaggggtggcccctgagcaagatggacatcggcgtgcccctcctggcgatcgggtgctactcccaggtcaacccgatcaccctgaccgccgccctcctgctgctcgtggcccactacgccatcatcggccccgggctgcaggcgaaggccacccgcgaggcccagaagcgggccgccgcgggcatcatgaagaaccccacggtggacggcatcaccgtcatcgacctggagcccatcccgtacgaccccaagttcgagaagcagctcggccaggtgatgctgctgatcctctgcgtgacccaggtcctgatgatgcgcaccacgtgggccctgtgcgaggccctcaccctggccaccggccccatcagcaccctgtgggaggggaaccccggccggttctggaacacgaccatcgccgtgtccatggcgaacatcttccgcgggagctacctcgccggcgccggcctgctgttctccatcatgaagaacaccaccagcacgcgccgggggaccggcaacatcggggagaccctcggcgagaagtggaagtcccgcctgaacgccctgggcaagagcgagttccagatctacaagaagtccgggatccaggaggtggaccggaccctcgcgaaggagggcatcaagcgcggggagacggaccaccacgccgtcagccggggctccgccaagctgcgctggttcgtggagcggaacatggtgaccccggaggggaaggtcgtggacctgggctgcggccgcgggggctggagctactactgcgggggcctcaagaacgtgcgggaggtcaaggggctgaccaagggcggccccgggcacgaggagcccatccccatgagcacctacggctggaacctggtgcgcctccagtccggggtggacgtcttcttcacgccgcccgagaagtgcgacaccctgctgtgcgacatcggcgagagctcccccaaccccaccatcgaggccgggcggaccctccgcgtgctgaacctggtggagaactggctcaacaacaacacccagttctgcatcaaggtcctgaacccgtacatgcccagcgtgatcgagaagatggaggccctgcagcggcagtacggcggcgcgctcgtgcgcaaccccctgtcccggaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctgggctccgggacgcgcaacatcggcatcgagaacgagatccccaacctcgacatcatcgggaagcggatcgagaagatcaagcaggagcacgagatcagctggcactacgaccaggaccacccctacaagacctgggcctaccacggctcctacgagaccaagcagaccggcagcgcctccagcatggtgaacggggtggtccgcctgctgacgaagccctgggacgtggtgccgatggtcacccagatggcgatgaccgacaccacgcccttcggccagcagcgcgtgttcaaggagaaggtggacacccggacccaggagcccaaggaggggaccaagaagctcatgaagatcacggccgagtggctgtggaaggagctgggcaagaagaagacgccccgcatgtgcacccgggaggagttcacccgcaaggtccggtccaacgccgccctcggcgccatcttcacggacgagaacaagtggaagtccgcgcgcgaggccgtggaggacgggcggttctgggagctggtggaccgcgagcggaacctgcacctcgagggcaagtgcgagacctgcgtctacaacatgatggggaagcgcgagaagaagctgggcgagttcgggaaggccaagggctcccgggccatctggtacatgtggctgggcgcgcgcttcctcgagttcgaggccctggggttcctgaacgaggaccactggttcagccggggcaacagcctctccggggtggagggcgaggggctgcaccgcctgggctacatcctccgggacgtcggcaagaaggagggcggcgccatgtacgccgacgacaccgccgggtgggacacccgcatcacgctggaggacctgaagaacgaggagatggtgaccaaccacatgaagggcgagcacaagaagctcgcggaggccatcttcaagctgacctaccagaacaaggtggtccgggtgcagcgcccgacgccccgggggacggtgatggacatcatcagccgccgggaccagcgcggctccggccaggtcgggacctacggcctgaacaccttcaccaacatggaggcccagctcatccgccagatggagggggagggcatcttcaagagcatccagcacctgacggccaccgaggagatcgccgtgcagaactggctggcgcgggtgggccgcgagcggctctcccgcatggccatcagcggggacgactgcgtcgtgaagcccatcgacgaccggttcgcctccgccctgaccgccctgaacgacatgggcaaggtgcgcaaggacatccagcagtgggagcccagccgggggtggaacgactggacccaggtcccgttctgctcccaccacttccacgagctcgtgatgaaggacggccgcgtgctggtcgtgccctgccggaaccaggacgagctgatcgggcgcgcgcggatcagccagggcgccggctggtccctcaaggagacggcctgcctgggcaagagctacgcccagatgtggaccctgatgtacttccaccgccgggacctccgcctggccgcgaacgccatctgctccgccgtgcccagccactgggtccccacctcccggaccacctggagcatccacgccaagcacgagtggatgacgaccgaggacatgctggcggtgtggaaccgcgtgtggatccaggagaacccgtggatggaggacaagacccccgtcgagtcctgggaggaggtgccctacctcggcaagcgggaggaccagtggtgcgggagcctgatcggcctgaccagccgcgccacgtgggccaagaacatccagaccgccatcaaccaggtgcggtccctcatcgggaacgaggagtacaccgactacatgcccagcatgaagcgcttccgccgggaggaggaggaggccggcgtcctgtggtga

SEQ ID NO: 9236 - RNA, 9876 nt, synthetic construct
  misc_feature 1..9876: note = derived and/or modified CDS sequence (opt1) from DENV-2__FJ850050__SS-prME
  source 1..9876: mol_type = other RNA
accgccggcgtgatcgtcatgctgatccccaccgccatggcgttccacctcacgacccgcaacggggagccgcacatgatcgtgggccggcaggagaaggggaagagcctgctgttcaagaccgaggacggcgtgaacatgtgcaccctcatggccatcgacctgggggagctgtgcgaggacacgatcacctacaagtgccccctcctgcgccagaacgagcccgaggacatcgactgctggtgcaactccaccagcacctgggtcacgtacggcacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctcttcggcaaggggggcatcgtcacctgcgcgatgttcacctgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgctccccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccgggggcacggagatccagatgagcagcggcaacctgctcttcaccgggcacctgaagtgccgcctgcggatggacaagctccagctgaagggcatgtcctacagcatgtgcaccgggaagttcaagatcgtgaaggagatcgccgagacccagcacggcacgatcgtgatccgcgtccagtacgagggcgacgggtccccctgcaagatccccttcgagatcaccgacctggagaagcggcacgtgctcggccgcctgatcaccgtgaacccgatcgtcaccgagaaggacagccccgtgaacatcgaggccgagccccccttcggggactcctacatcatcatcggcgtggagccggggcagctgaagctcaactggttcaagaagggcagctccatcggccagatgttcgagacgaccatgcgcggggcgaagcggatggccatcctgggcgacaccgcctgggacttcgggagcctgggcggggtcttcacctccatcggcaaggccctccaccaggtgttcggcgccatctacggggcggccttcagcggcgtgtcctggacgatgaagatcctgatcggggtcatcatcacctggatcggcatgaacagccgctccaccagcctgtccgtgagcctggtgctcgtcggggtggtgaccctgtacctgggcgccgtcgtgcaggccgactccggctgcgtggtcagctggaagaacaaggagctcaagtgcgggtccggcatcttcatcacggacaacgtgcacacctggaccgagcagtacaagttccagcccgagagccccagcaagctggcgtccgccatccagaaggcccacgaggaggggatctgcggcatccggagcgtgacccgcctggagaacctcatgtggaagcagatcacgcccgagctgaaccacatcctgtccgagaacgaggtcaagctcaccatcatgaccggggacatcaagggcatcatgcaggccggcaagcggagcctgcgcccgcagcccaccgagctgaagtactcctggaagacgtgggggaaggccaagatgctcagcaccgagtcccacaaccagaccttcctgatcgacggccccgagaccgcggagtgcccgaacacgaaccgggcctggaacagcctggaggtggaggactacgggttcggcgtgttcaccaccaacatctggctcaagctgcgcgagaagcaggacgtcttctgcgactccaagctgatgagcgccgccatcaagtacaaccgggccgtgcacgcggacatgggctactggatcgagtccgccccctgcgacagctgggagatgcagaaggcctccttcatcgaggtgatcagctgccactggcccaagtccctcaccctgtggagcaacggggtcctggagtccgagatgatcatccccaagaacttcgccggcccggtgagccagcacaactaccgccccgggtaccacacccagacggccggcccctggcacctcgggaagctggagatggacttcgacttctgcgagggcaccaccgtggtcgtgaccgaggactgcggcaaccgggggcccagcctgcgcacgaccaccgcgtccggcaagctcatcaccgagtggtgctgccggagctgcacgctgccgcccctgcgctaccggggggaggacggctgctggtacgggatggagatccgccccctcaaggagaaggaggagaacctggtgaactccctggtcaccgccggccacggccagatcgacaacttcagcctcggggtgctgggcatggccctgttcctcgaggagatgctgcggacccgcatcgggaccaagcacgccatcctgctcgtggcggtctccttcgtgacgctgatcaccggcaacatgagcttccgggacctggggcgcgtgatggtcatggtgggcgccaccatgaccgacgacatcggcatgggggtgacgtacctcgccctgctggccgccttcaaggtccgccccaccttcgcggccggcctcctgctgcggaagctcacctccaaggagctgatgatggccaccatcgggatcgccctgctcagccagtccacgatcccggagaccatcctggagctgaccgacgccctcgcgctgggcatgatggtgctgaagatcgtgcgcaacatggagaagtaccagctcgccgtcaccatcatggccatcagctgcgtgcccaacgccgtgatcctgcagaacgcctggaaggtctcctgcacgatcctggcggccgtgagcgtctcccccctcctgctgaccagctcccagcagaaggccgactggatccccctcgccctgaccatcaagggcctgaacccgaccgcgatcttcctcacgaccctgagccggacctccaagaagcgcagctggcccctgaacgaggccatcatggccgtggggatggtgtccatcctcgccagcagcctgctgaagaacgacatccccatgaccggccccctcgtcgccgggggcctgctgacggtgtgctacgtgctcaccgggcggtccgcggacctggagctggagcgcgccgccgacgtcaagtgggaggaccaggccgagatcagcggctccagcccgatcctctccatcaccatcagcgaggacggctccatgagcatcaagaacgaggaggaggagcagaccctgacgatcctgatccggaccgggctcctggtgatctccggcgtgttccccgtcagcatccccatcaccgccgcggcctggtacctgtgggaggtgaagaagcagcgcgccggggtgctctgggacgtcccctccccgccccccgtggagaaggccgagctggaggacggcgcctaccggatcaagcagcgcgggatcctgggctacagccagatcggcgcgggggtgtacaaggagggcaccttccacaccatgtggcacgtcacgcggggggccgtgctcatgcaccgcggcaagcggatcgagccgtcctgggccgacgtgaagaaggacctgatcagctacgggggcggctggaagctggagggggagtggaaggagggcgaggaggtccaggtgctcgccctggagcccgggaagaacccccgcgccgtgcagaccaagcccggcatcttcaagaccaacaccgggacgatcggcgcggtctccctggacttcagcccgggcacctccgggagccccatcgtggaccggaagggcaaggtggtcgggctctacggcaacggcgtggtgacccgctccggggcctacgtcagcgccatcgcccagaccgagaagagcatcgaggacaaccccgagatcgaggacgacatcttccggaagaagcgcctgacgatcatggacctgcaccccggcgcggggaagaccaagcggtacctcccggccatcgtgcgcgaggccatcaagcggggcctgcgcaccctgatcctggcccccacccgcgtggtcgccgcggagatggaggaggccctccgggggctgcccatccgctaccagacgcccgccatcaagaccgagcacaccggccgggagatcgtggacctgatgtgccacgccaccttcacgatgcgcctcctgtccccggtgcgggtccccaactacaacctgatcatcatggacgaggcccacttcaccgaccccgcgagcatcgccgcccgcggctacatctccacccgggtggagatgggggaggccgccggcatcttcatgaccgcgacgcccccggggagccgcgaccccttcccccagtccaacgcccccatcatggacgaggagcgggagatcccggagcgcagctggaactccggccacgagtgggtgaccgacttcaaggggaagaccgtctggttcgtgcccagcatcaaggccggcaacgacatcgccgcgtgcctccggaagaacggcaagaaggtgatccagctgtcccgcaagaccttcgacagcgagtacgtcaagacgcgggccaacgactgggacttcgtggtgaccaccgacatctccgagatgggggccaacttcaaggccgagcgcgtcatcgacccccggcgctgcatgaagcccgtgatcctgaccgacggcgaggagcgggtgatcctcgccgggccgatgcccgtcacgcacagctccgcggcccagcgccggggccgcatcgggcgcaaccccaagaacgagaacgaccagtacatctacatgggcgagcccctggagaacgacgaggactgcgcccactggaaggaggccaagatgctgctcgacaacatcaacaccccggagggcatcatccccagcatgttcgagcccgagcgggagaaggtggacgccatcgacggggagtaccgcctgcggggcgaggcgcgcaagaccttcgtggacctgatgcggcgcggggacctcccggtctggctggcctacaaggtggccgccgagggcatcaactacgccgaccggaagtggtgcttcgacgggatcaagaacaaccagatcctggaggagaacatgcaggagcagatctggaccaaggagggcgagcgcaagaagctcaagccccggtggctggacgcgcgcatctactccgaccccctggccctcaaggagttcaaggagttcgccgccggccggaagagcctgacgctgaacctcatcaccgagatggggcgcctgcccaccttcatgacccagaaggcgcggaacgccctggacaacctcgccgtgctgcacacggccgaggccggcgggcgcgcgtacaaccacgccctgtccgagctcccggagaccctggagaccctgctcctgctgaccctcctggccacggtcaccggcggcatcttcctgttcctcatgagcgggaagggcatcgggaagatgaccctgggcatgtgctgcatcatcaccgcctccatcctgctctggtacgcccagatccagccccactggatcgcggccagcatcatcctggagttcttcctgatcgtgctcctgatccccgagcccgagaagcagcggaccccgcaggacaaccagctgacgtacgtcgtgatcgccatcctcaccgtggtcgccgccaccatggcgaacgagatggggttcctggagaagaccaagaaggacctgggcctcggcagcatcacgacccaggagtccgagagcaacatcctggacatcgacctgcgccccgcctccgcctggaccctctacgccgtggccaccacgttcgtgacccccatgctgcggcacagcatcgagaactccagcgtcaacgtgtccctgaccgcgatcgccaaccaggccaccgtgctcatggggctgggcaaggggtggcccctgagcaagatggacatcggcgtcccgctcctggccatcgggtgctactcccaggtgaaccccatcacgctgaccgcggccctcctgctgctcgtggcccactacgccatcatcggccccggcctgcaggccaaggcgacccgcgaggcccagaagcgggccgccgccgggatcatgaagaaccccaccgtcgacggcatcacggtgatcgacctggagccgatcccctacgaccccaagttcgagaagcagctcgggcaggtgatgctgctgatcctctgcgtcacccaggtgctgatgatgcgcaccacctgggcgctgtgcgaggccctcacgctggccaccggccccatcagcaccctgtgggaggggaacccgggccggttctggaacaccacgatcgccgtgtccatggccaacatcttccgcggcagctacctcgcgggggccggcctgctgttctccatcatgaagaacaccaccagcacccgccgggggacgggcaacatcggcgagaccctcggggagaagtggaagtcccgcctgaacgccctgggcaagagcgagttccagatctacaagaagtccgggatccaggaggtcgaccggaccctcgccaaggagggcatcaagcgcggggagaccgaccaccacgcggtgagccggggctccgccaagctgcgctggttcgtggagcggaacatggtcacgcccgagggcaaggtggtggacctggggtgcggccgcgggggctggagctactactgcgggggcctcaagaacgtccgggaggtgaagggcctgaccaaggggggccccgggcacgaggagcccatcccgatgagcacctacggctggaacctggtgcgcctccagtccggggtcgacgtgttcttcaccccccccgagaagtgcgacacgctgctgtgcgacatcggcgagagctcccccaacccgaccatcgaggccggccggaccctccgcgtgctgaacctggtcgagaactggctcaacaacaacacccagttctgcatcaaggtgctgaacccctacatgcccagcgtgatcgagaagatggaggccctgcagcggcagtacgggggcgccctcgtccgcaacccgctgtcccggaacagcacccacgagatgtactgggtgtccaacgcgacggggaacatcgtgagctccgtcaacatgatcagccgcatgctgatcaaccggttcaccatgaagcacaagaaggccacctacgagcccgacgtggacctgggctccgggacccgcaacatcggcatcgagagcgagatccccaacctcgacatcatcggcaagcggatcgagaagatcaagcaggagcacgagatctcctggcactacgaccaggaccacccctacaagacgtgggcctaccacgggagctacgagaccaagcagaccggctccgccagctccatggtgaacggggtcgtgcgcctgctgaccaagccgtgggacgtggtccccatggtgacgcagatggccatgaccgacaccacccccttcggccagcagcgcgtgttcaaggagaaggtcgacacgcggacccaggagcccaaggagggcaccaagaagctcatgaagatcaccgcggagtggctgtggaaggagctggggaagaagaagacgccgcgcatgtgcacccgggaggagttcaccaagaaggtgcgcagcaacgccgccctcggcgccatcttcaccgacgagaacaagtggaagtccgcccgggaggcggtggaggacgggcgcttctgggagctggtcgaccgggagcgcaacctgcacctcgagggcaagtgcgagacgtgcgtgtacaacatgatggggaagcgggagaagaagctgggcgagttcggcaaggccaaggggagccgcgccatctggtacatgtggctgggcgcccggttcctcgagttcgaggcgctggggttcctgaacgaggaccactggttcagccgcggcaactccctcagcggggtggagggcgagggcctgcaccggctggggtacatcctccgcgacgtcggcaagaaggaggggggcgccatgtacgccgacgacaccgccgggtgggacacccggatcaccctggaggacctgaagaacgaggagatggtgacgaaccacatgaagggcgagcacaagaagctcgccgaggcgatcttcaagctgacctaccagaacaaggtcgtgcgcgtgcagcggcccaccccccgcggcaccgtcatggacatcatctcccggcgcgaccagcgggggagcggccaggtggggacgtacggcctgaacaccttcaccaacatggaggcccagctcatccgccagatggagggcgaggggatcttcaagtccatccagcacctgaccgccacggaggagatcgccgtgcagaactggctggcccgcgtcggccgggagcgcctcagccggatggcgatctccggggacgactgcgtggtgaagcccatcgacgaccgcttcgccagcgccctgaccgccctgaacgacatgggcaaggtccggaaggacatccagcagtgggagccgtcccgcgggtggaacgactggacccaggtgcccttctgcagccaccacttccacgagctcgtgatgaaggacggccgggtcctggtggtgccctgccgcaaccaggacgagctgatcggccgggcccgcatctcccagggggcgggctggagcctcaaggagaccgcctgcctggggaagtcctacgcccagatgtggacgctgatgtacttccaccggcgcgacctccggctggccgccaacgcgatctgcagcgccgtcccctcccactgggtgccgaccagccgcaccacctggtccatccacgccaagcacgagtggatgaccacggaggacatgctggccgtgtggaaccgggtctggatccaggagaacccctggatggaggacaagacccccgtggagagctgggaggaggtgccctacctcggcaagcgcgaggaccagtggtgcgggagcctgatcggcctgacctcccgggcgacctgggccaagaacatccagacggccatcaaccaggtccgcagcctcatcggcaacgaggagtacaccgactacatgccgtccatgaagcggttccgccgcgaggaggaggaggccggggtgctgtggtga

SEQ ID NO: 9237 - RNA, 9876 nt, synthetic construct
  misc_feature 1..9876: note = derived and/or modified CDS sequence (opt1) from DENV-2__FJ639837__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatggtgatccccaagaacttcgccgggcccgtgtcccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcatcggcacgaagcacgcgatcctgctcgtcgccgtgagcttcgtgaccctgatcaccgggaacatgtccttccgggacctgggccgcgtcatggtgatggtgggggccaccatgacggacgacatcggcatgggcgtcacctacctcgccctgctggccgcgttcaaggtgcgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtccgcaacatggagaagtaccagctcgccgtgacgatcatggccatctcctgcgtgccgaacgccgtcatcctgcagaacgcgtggaaggtgagctgcaccatcctggccgccgtctccgtgagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtcagcatcctcgcctccagcctgctgaagaacgacatccccatgacggggcccctcgtggcgggcgggctgctgaccgtgtgctacgtcctcaccggccggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtcttcccggtgtccatccccatcaccgcggccgcctggtacctgtgggaggtgaagaagcagcgcgccggcgtcctctgggacgtgcccagcccgccgcccgtggagaaggccgagctggaggacggggcgtaccggatcaagcagcgcggcatcctggggtactcccagatcggcgccggcgtctacaaggaggggaccttccacacgatgtggcacgtgacccggggcgccgtgctcatgcaccgcgggaagcggatcgagcccagctgggccgacgtcaagaaggacctgatctcctacggcgggggctggaagctggagggcgagtggaaggagggggaggaggtccaggtgctcgccctggagcccggcaagaacccccgcgcggtccagaccaagcccgggatcttcaagaccaacacgggcaccatcggggccgtgagcctggacttctcccccggcaccagcggctcccccatcgtggaccggaaggggaaggtcgtgggcctctacgggaacggcgtggtcacccgcagcggcgcctacgtgtccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtcgtggcggccgagatggaggaggccctccggggcctgcccatccgctaccagacccccgccatcaagaccgagcacaccgggcgggagatcgtggacctgatgtgccacgccacgttcaccatgcgcctcctgagccccgtccgggtgccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgcggcctgcctccggaagaacggcaagaaggtcatccagctgagccgcaagacgttcgactccgagtacgtgaagacccgggccaacgactgggacttcgtggtcaccaccgacatcagcgagatgggcgccaacttcaaggccgagcgcgtgatcgacccccggcgctgcatgaagcccgtgatcctgacggacggggaggagcgggtcatcctcgcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtcgacctgatgcggcgcggcgacctccccgtgtggctggcctacaaggtggccgccgaggggatcaactacgcggaccggaagtggtgcttcgacggcatcaagaacaaccagatcctggaggagaacatggaggtcgagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtgctgcacaccgccgaggccgggggccgcgcctacaaccacgccctgagcgagctccccgagaccctggagaccctgctcctgctgacgctcctggccaccgtcaccgggggcatcttcctgttcctcatgtccggcaagagcatcgggaagatgaccctgggcatgtgctgcatcatcaccgcctccatcctgctctggcacgcgcagatccagccgcactggatcgccgccagcatcatcctggagttcttcctgatcgtgctcctgatccccgagcccgagaagcagcggacgccccaggacaaccagctgacctacgtggtcatcgccatcctcaccgtggtggccgcgaccatggccaacgagatggggttcctggagaagacgaagaaggacctgggcctcgggagcatcaccacccaggagtccgagagcaacatcctggacatcgacctgcgcccggcctccgcctggaccctctacgccgtcgcgacgaccttcgtgacccccatgctgcggcacagcatcgagaactccagcgtgaacgtctccctgaccgccatcgccaaccaggccacggtgctcatgggcctgggcaaggggtggcccctgagcaagatggacatcggcgtgcccctcctggcgatcgggtgctactcccaggtcaacccgatcaccctgaccgccgccctcctgctgctcgtggcccactacgccatcatcggccccgggctgcaggcgaaggccacccgcgaggcccagaagcgggccgccgcgggcatcatgaagaaccccacggtggacggcatcaccgtcatcgacctggcccccatcccgtacgaccccaagttcgagaagcagctcggccaggtgatgctgctgatcctctgcgtgacccaggtcctgatgatgcgcaccacgtgggccctgtgcgaggccctcaccctggccaccggccccatcagcaccctgtgggaggggaaccccggccggttctggaacacgaccatcgcggtgtccatggccaacatcttccgcgggagctacctcgccggcgccggcctgctgttctccatcatgaagaacaccaccagcacgcgccgggggaccggcaacatcggggagaccctcggcgagaagtggaagtcccgcctgaacgcgctgggcaagagcgagttccagatctacaagaagtccgggatccaggaggtggaccggaccctcgccaaggagggcatcaagcgcggggagacggaccaccacgccgtcagccggggctccgccaagctgcgctggttcgtggagcggaacatggtgaccccggaggggaaggtcgtggacctgggctgcggccgcgggggctggagctactactgcgggggcctcaagaacgtgcgggaggtcaaggggctgaccaagggcggccccgggcacgaggagcccatccccatgagcacctacggctggaacctggtgcgcctccagtccggggtggacgtcttcttcacgccgcccgagaagtgcgacaccctgctgtgcgacatcggcgagagctcccccaaccccaccatcgaggccgggcggaccctccgcgtgctgaacctggtggagaactggctcaacaacaacacccagttctgcatcaaggtcctgaacccgtacatgcccagcgtgatcgagaagatggaggcgctgcagcggcagtacggcggcgccctcgtgcgcaaccccctgtcccggaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctgggctccgggacgcgcaacatcggcatcgagaacgagatccccaacctcgacatcatcgggaagcggatcgagaagatcaagcaggagcacgagatcagctggcactacgaccaggaccacccctacaagacctgggcctaccacggctcctacgagaccaagcagaccggcagcgcgtccagcatggtgaacggggtggtccgcctgctgacgaagccctgggacgtggtgccgatggtcacccagatggccatgaccgacaccacgcccttcggccagcagcgcgtgttcaaggagaaggtggacacccggacccaggagcccaaggaggggaccaagaagctcatgaagatcacggccgagtggctgtggaaggagctgggcaagaagaagacgccccgcatgtgcacccgggaggagttcacccgcaaggtccggtccaacgccgccctcggcgcgatcttcacggacgagaacaagtggaagtccgcccgcgaggccgtggaggacgggcggttctgggagctggtggaccgcgagcggaacctgcacctcgagggcaagtgcgagacctgcgtctacaacatgatggggaagcgcgagaagaagctgggcgagttcgggaaggccaagggctcccgggcgatctggtacatgtggctgggcgcccgcttcctcgagttcgaggccctggggttcctgaacgaggaccactggttcagccggggcaacagcctctccggggtggagggcgaggggctgcaccgcctgggctacatcctccgggacgtcgccaagaaggagggcggggccatgtacgcggacgacaccgccggctgggacacccgcatcacgctggaggacctgaagaacgaggagatggtgaccaaccacatgaagggggagcacaagaagctcgccgaggccatcttcaagctgacctaccagaacaaggtggtccgggtgcagcgcccgacgccccggggcacggtgatggacatcatcagccgccgggaccagcgcgggtccggccaggtcggcacctacgggctgaacaccttcaccaacatggaggcccagctcatccgccagatggagggcgaggggatcttcaagagcatccagcacctgacggcgaccgaggagatcgccgtgcagaactggctggcccgggtgggccgcgagcggctctcccgcatggccatcagcggcgacgactgcgtcgtgaagcccatcgacgaccggttcgcctccgcgctgaccgccctgaacgacatggggaaggtgcgcaaggacatccagcagtgggagcccagccggggctggaacgactggacccaggtcccgttctgctcccaccacttccacgagctcgtgatgaaggacgggcgcgtgctggtcgtgccctgccggaaccaggacgagctgatcggccgcgcccggatcagccagggggccggctggtccctcaaggagacggcctgcctgggcaagagctacgcgcagatgtggaccctgatgtacttccaccgccgggacctccgcctggccgccaacgccatctgctccgcggtgcccagccactgggtccccacctcccggaccacctggagcatccacgccaagcacgagtggatgacgaccgaggacatgctggccgtgtggaaccgcgtgtggatccaggagaacccgtggatggaggacaagacccccgtcgagtcctgggaggaggtgccctacctcgggaagcgggaggaccagtggtgcggcagcctgatcgggctgaccagccgcgccacgtgggccaagaacatccagaccgcgatcaaccaggtgcggtccctcatcggcaacgaggagtacaccgactacatgcccagcatgaagcgcttccgccgggaggaggaggaggccggggtcctgtggtga

SEQ ID NO: 9238 - RNA, 9876 nt, synthetic construct
  misc_feature 1..9876: note = derived and/or modified CDS sequence (opt1) from DENV-2__FJ744706__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgggtcccacaaccagaccttcctgatcgacggccccgagaccgccgagtgcccgaacacgaaccgggcctggaacagcctggaggtggaggactacgggttcggcgtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggggtcctggagagcgagatgatcatccccaagaacttcgccggccccgtgtcccagcacaactaccgcccggggtaccacacgcagaccgcgggcccctggcacctcgggaagctggagatggacttcgacttctgcgagggcaccaccgtggtcgtgacggaggactgcggcaaccgggggcccagcctgcgcaccaccaccgccagcggcaagctcatcacggagtggtgctgccggtcctgcaccctgcccccgctgcgctaccgcggggaggacggctgctggtacgggatggagatccgccccctcaaggagaaggaggagaacctggtgaacagcctggtcaccgccggccacggccagatcgacaacttctccctcggggtgctgggcatggccctgttcctcgaggagatgctgcggacccgcatcgggacgaagcacgcgatcctgctcgtggccgtcagcttcgtgaccctgatcaccggcaacatgtccttccgggacctggggcgcgtgatggtcatggtgggcgccaccatgacggacgacatcggcatgggggtgacctacctcgccctgctggccgcgttcaaggtccgccccaccttcgccgccggcctcctgctgcggaagctcaccagcaaggagctgatgatggccacgatcgggatcgccctgctctcccagagcaccatccccgagaccatcctggagctgaccgacgcgctcgccctgggcatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtggggatggtgagcatcctcgcctccagcctgctgaagaacgacatccccatgacgggccccctcgtcgccgggggcctgctgaccgtgtgctacgtgctcaccgggcggagcgccgacctggagctggagcgcgccgccgacgtcaagtgggaggaccaggccgagatctccggcagctcccccatcctcagcatcaccatctccgaggacggcagcatgtccatcaagaacgaggaggaggagcagacgctgaccatcctgatccggaccgggctcctggtgatcagcggcgtgttcccggtctccatccccatcaccgcggccgcctggtacctgtgggaggtgaagaagcagcgcgccggggtgctctgggacgtccccagcccgccgcccgtggagaaggccgagctggaggacggcgcgtaccggatcaagcagcgcgggatcctgggctactcccagatcggcgccggggtgtacaaggagggcaccttccacacgatgtggcacgtcacccgcggggcggtgctcatgcaccggggcaagcggatcgagcccagctgggccgacgtgaagaaggacctgatctcctacgggggcggctggaagctggagggggagtggaaggagggcgaggaggtccaggtgctcgccctggagcccgggaagaacccccgcgcggtgcagaccaagcccggcatcttcaagaccaacacggggaccatcggcgccgtcagcctggacttctcccccggcaccagcgggtcccccatcgtggaccggaagggcaaggtggtcgggctctacggcaacggcgtggtgacccgcagcggggcctacgtctccgccatcgcgcagacggagaagtccatcgaggacaaccccgagatcgaggacgacatcttccggaagaagcgcctgaccatcatggacctgcaccccggcgccgggaagaccaagcggtacctccccgccatcgtgcgcgaggccatcaagcggggcctgcgcaccctgatcctggccccgacgcgcgtggtcgcggccgagatggaggaggccctccgggggctgcccatccgctaccagacccccgccatcaagaccgagcacaccggccgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggggaggccgcgggcatcttcatgacggccacgccgcccgggtcccgcgacccgttcccccagagcaacgcccccatcatggacgaggagcgggagatccccgagcgctcctggaacagcggccacgagtgggtgaccgacttcaaggggaagaccgtctggttcgtgccgtccatcaaggccggcaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggggccaacttcaaggccgagcgcgtcatcgacccccggcgctgcatgaagcccgtgatcctgacggacggcgaggagcgggtgatcctcgcggggcccatgccggtcacccactccagcgccgcccagcgccggggccgcatcgggcgcaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgggagaaggtggacgcgatcgacggggagtaccgcctgcggggcgaggcccgcaagaccttcgtggacctgatgcggcgcggggacctccccgtctggctggcctacaaggtggccgccgagggcatcaactacgcggaccggaagtggtgcttcgacgggatcaagaacaaccagatcctggaggagaacatggaggtggagatctggacgaaggagggcgagcgcaagaagctcaagccgcggtggctggacgcccgcatctacagcgaccccctggccctcaaggagttcaaggagttcgccgcgggccggaagtccctgaccctgaacctcatcaccgagatggggcgcctgcccaccttcatgacgcagaaggcccggaacgccctggacaacctcgccgtcctgcacaccgccgaggcgggcgggcgcgcctacaaccacgccctgagcgagctccccgagaccctggagaccctgctcctgctgacgctcctggccaccgtgaccggcggcatcttcctgttcctcatgtccgggaagggcatcgggaagatgaccctgggcatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatggggttcctggagaagacgaagaaggacctgggcctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatggggctgggcaaggggtggcccctgtccaagatggacatcggcgtgcccctcctggcgatcgggtgctacagccaggtgaacccgatcaccctgaccgccgccctcctgctgctcgtcgcccactacgccatcatcggccccggcctgcaggcgaaggccacccgcgaggcccagaagcgggccgccgcggggatcatgaagaaccccacggtggacggcatcaccgtgatcgacctggagcccatcccgtacgaccccaagttcgagaagcagctcgggcaggtcatgctgctgatcctctgcgtgacccaggtgctgatgatgcgcaccacgtgggccctgtgcgaggccctcaccctggccaccggccccatctccaccctgtgggaggggaaccccggccggttctggaacacgaccatcgccgtcagcatggcgaacatcttccgcggctcctacctcgccggggccggcctgctgttcagcatcatgaagaacaccacctccacgcgccgggggaccggcaacatcggcgagaccctcggggagaagtggaagtcccgcctgaacgccctgggcaagtccgagttccagatctacaagaagtccgggatccaggaggtggaccggaccctcgcgaaggagggcatcaagcgcggggagacggaccaccacgccgtgtcccggggcagcgccaagctgcgctggttcgtcgagcggaacatggtgaccccggagggcaaggtggtcgacctggggtgcggccgcgggggctggtcctactactgcgggggcctcaagaacgtgcgggaggtgaagggcctgaccaagggcggccccgggcacgaggagcccatccccatgagcacctacggctggaacctggtccgcctccagagcggggtggacgtgttcttcacgccgcccgagaagtgcgacaccctgctgtgcgacatcggcgagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacgggggcgcgctcgtgcgcaaccccctgagccggaactccacgcacgagatgtactgggtgagcaacgccaccgggaacatcgtctccagcgtgaacatgatctcccgcatgctgatcaaccggttcaccatgaagcacaagaaggccacctacgagccggacgtggacctgggcagcgggacgcgcaacatcggcatcgagtccgagatccccaacctcgacatcatcggcaagcggatcgagaagatcaagcaggagcacgagatcagctggcactacgaccaggaccacccctacaagacctgggcctaccacgggtcctacgagaccaagcagaccggcagcgcctccagcatggtcaacggggtggtgcgcctgctgacgaagccctgggacgtcgtgccgatggtgacccagatggcgatgaccgacaccacgcccttcggccagcagcgcgtcttcaaggagaaggtggacacccggacccaggagcccaaggagggcaccaagaagctcatgaagatcacggccgagtggctgtggaaggagctggggaagaagaagacgccccgcatgtgcacccgggaggagttcaccaagaaggtgcgcggcaacgccgccctcggggccatcttcacggacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggcgagttcgggaaggccaagggcagccgcgccatctggtacatgtggctgggggcgcggttcctcgagttcgaggccctgggcttcctgaacgaggaccactggttctcccgcgggaacagcctcagcggcgtcgagggcgaggggctgcaccggctgggctacatcctccgcgacgtggggaagaaggagggcggggccatgtacgccgacgacaccgccggctgggacacccggatcacgctggaggacctgaagaacgaggagatggtcaccaaccacatgaagggcgagcacaagaagctcgcggaggccatcttcaagctgacctaccagaacaaggtggtgcgcgtccagcggccgacgccccgcgggacggtgatggacatcatctcccggcgcgaccagcggggcagcggccaggtggggacctacggcctgaacaccttcaccaacatggaggcccagctcatccgccagatggagggggagggcatcttcaagtccatccagcacctgacggccaccgaggagatcgccgtccagaactggctggcgcgcgtggggcgggagcgcctcagccggatggccatctccggcgacgactgcgtggtcaagcccatcgacgaccgcttcgccagcgccctgaccgccctgaacgacatggggaaggtgcggaaggacatccagcagtgggagccctcccgcggctggaacgactggacccaggtgccgttctgcagccaccacttccacgagctcgtcatgaaggacggccgggtgctggtggtcccctgccgcaaccaggacgagctgatcgggcgggcgcgcatctcccagggcgccgggtggagcctcaaggagacggcctgcctgggcaagtcctacgcccagatgtggaccctgatgtacttccaccggcgcgacctccggctggccgcgaacgccatctgcagcgccgtgccctcccactgggtgcccaccagccgcaccacctggtccatccacgccaagcacgagtggatgacgaccgaggacatgctggcggtctggaaccgggtgtggatccaggagaacccgtggatggaggacaagacccccgtggagagctgggaggaggtcccctacctcgggaagcgcgaggaccagtggtgcggctccctgatcggcctgaccagccgggccacgtgggccaagaacatccagaccgccatcaaccaggtgcgcagcctcatcgggaacgaggagtacaccgactacatgccctccatgaagcggttccgccgcgaggaggaggaggccggcgtgctgtggtga

SEQ ID NO: 9239 - RNA, 9876 nt, synthetic construct
  misc_feature 1..9876: note = derived and/or modified CDS sequence (opt1) from DENV-2__FJ744707__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatgggcctggggaagggctggcccctgtccaagatggacatcggggtgcccctcctggcgatcggctgctacagccaggtgaacccgatcaccctgaccgccgccctcctgctgctcgtcgcccactacgccatcatcgggcccggcctgcaggcgaaggccacccgcgaggcccagaagcgggccgccgcgggcatcatgaagaaccccacggtggacgggatcaccgtgatcgacctggagcccatcccgtacgaccccaagttcgagaagcagctcggccaggtcatgctgctgatcctctgcgtgacccaggtgctgatgatgcgcaccacgtgggccctgtgcgaggccctcaccctggccaccgggcccatctccaccctgtgggagggcaaccccgggcggttctggaacacgaccatcgccgtcagcatggcgaacatcttccgcggctcctacctcgccggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagacggaccaccacgccgtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacctacgggtggaacctggtccgcctccagagcggcgtggacgtgttcttcacgccgcccgagaagtgcgacaccctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacgcacgagatgtactgggtgagcaacgccaccggcaacatcgtctccagcgtgaacatgatctcccgcatgctgatcaaccggttcaccatgaagcacaagaaggccacctacgagccggacgtggacctggggagcggcacgcgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagaccgggagcgcctccagcatggtcaacggcgtggtgcgcctgctgacgaagccctgggacgtcgtgccgatggtgacccagatggcgatgaccgacaccacgcccttcgggcagcagcgcgtcttcaaggagaaggtggacacccggacccaggagcccaaggagggcaccaagaagctcatgaagatcacggccgagtggctgtggaaggagctgggcaagaagaagacgccccgcatgtgcacccgggaggagttcaccaagaaggtgcgctccaacgccgccctcggggccatcttcacggacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacccggatcacgctggaggacctgaagaacgaggagatggtcaccaaccacatgaagggggagcacaagaagctcgcggaggccatcttcaagctgacctaccagaacaaggtggtgcgcgtccagcggccgacgccccgcggcacggtgatggacatcatcagccggcgcgaccagcggggctccgggcaggtcggcacctacgggctgaacaccttcaccaacatggaggcccagctcatccgccagatggagggcgagggcatcttcaagagcatccagcacctgacggccaccgaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggcgccctgccgcaaccaggacgagctgatcggccgggcccgcatcagccagggcgccgggtggtccctcaaggagacggcctgcctgggcaagagctacgcccagatgtggaccctgatgtacttccaccggcgcgacctccggctggcggccaacgccatctgctccgccgtccccagccactgggtgcccacctcccgcaccacctggagcatccacgcgaagcacgagtggatgacgaccgaggacatgctggccgtgtggaaccgggtctggatccaggagaacccgtggatggaggacaagacccccgtggagtcctgggaggaggtgccctacctcgggaagcgcgaggaccagtggtgcggcagcctgatcgggctgaccagccgggccacgtgggccaagaacatccagaccgccatcaaccaggtccgctccctcatcggcaacgaggagtacaccgactacatgcccagcatgaagcggttccgccgcgaggaggaggaggcgggcgtgctgtggtga

SEQ ID NO: 9240 - RNA, 9876 nt, synthetic construct
  misc_feature 1..9876: note = derived and/or modified CDS sequence (opt1) from DENV-2__FJ744704__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatgttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagacccccgccatcaagaccgagcacaccgggcgcgagatcgtcgacctcatgtgccacgccacgttcaccatgcggctgctgagccccgtgcgcgtgccgaactacaacctcatcatcatggacgaggcgcacttcaccgaccccgcctccatcgccgcccggggctacatcagcacccgcgtcgagatgggcgaggccgcggggatcttcatgacggccacgccgcccggctcccgggacccgttcccccagagcaacgcccccatcatggacgaggagcgcgagatccccgagcggtcctggaacagcgggcacgagtgggtgaccgacttcaagggcaagaccgtgtggttcgtcccgtccatcaaggccgggaacgacatcgcggcctgcctgcgcaagaacggcaagaaggtgatccagctgagccggaagacgttcgactccgagtacgtgaagacccgcgccaacgactgggacttcgtcgtgaccaccgacatcagcgagatgggcgccaacttcaaggccgagcgggtgatcgacccccgccggtgcatgaagcccgtcatcctcacggacggggaggagcgcgtgatcctggcgggccccatgccggtgacccactccagcgccgcccagcggcgcgggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtcgacgcgatcgacggcgagtaccggctgcgcggggaggcccggaagaccttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggacgaaggagggggagcggaagaagctgaagccgcgctggctggacgcccggatctacagcgaccccctcgccctgaaggagttcaaggagttcgccgcgggccgcaagtccctgaccctcaacctgatcaccgagatgggccggctgcccaccttcatgacgcagaaggcccgcaacgccctcgacaacctggccgtgctgcacaccgccgaggccgggggccgggcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcgcacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccggccggccagcgcctggaccctgtacgccgtggcgacgaccttcgtgacccccatgctgcgccactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacccgggaggcccagaagcgcgccgccgcgggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaaccccgggcgcttctggaacacgaccatcgccgtgagcatggcgaacatcttccgcggctcctacctggccggcgccgggctcctgttcagcatcatgaagaacaccaccaacacgcggcgcggcaccgggaacatcggcgagaccctgggcgagaagtggaagtcccggctgaacgccctcggcaagagcgagttccagatctacaagaagtccggcatccaggaggtcgaccgcaccctggcgaaggaggggatcaagcggggcgagacggaccaccacgccgtgagccgcgggtccgccaagctgcggtggttcgtggagcgcaacatggtcaccccggagggcaaggtggtggacctcggctgcgggcggggcgggtggagctactactgcggcgggctgaagaacgtccgcgaggtgaagggcctgaccaagggcgggcccggccacgaggagcccatccccatgtccacctacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacccagttctgcatcaaggtgctgaacccgtacatgcccagcgtgatcgagaagatggaggccctccagcgcaagtacggcggggcgctggtccggaaccccctgtcccgcaacagcacgcacgagatgtactgggtgtccaacgccaccggcaacatcgtgagctccgtcaacatgatcagccggatgctgatcaaccgcttcaccatgaagcacaagaaggccacctacgagccggacgtggacctcgggtccggcacgcggaacatcgggatcgagagcgagatccccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccctgggacgtggtcccgatggtgacccagatggcgatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatctgcacccgcgaggagttcacgcggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgagaacagcctgagcggggtggagggcgaggggctgcaccggctcggctacatcctgcgcgacgtcggcaagaaggagggcggcgccatgtacgccgacgacaccgccgggtgggacacgcggatcaccctggaggacctcaagaacgaggagatggtgaccaaccacatgaagggcgagcacaagaagctggcggaggccatcttcaagctgacctaccagaacaaggtcgtgcgcgtgcagcggccgacgccccgcgggaccgtcatggacatcatctcccggcgcgaccagcgcggcagcggccaggtggggacctacggcctcaacaccttcacgaacatggaggcccagctgatccggcagatggagggggagggcatcttcaagtccatccagcacctgaccgccaccgaggagatcgccgtgcagaactggctcgcgcgcgtcggccgggagcgcctgagccggatggccatctccggggacgactgcgtggtgaagcccatcgacgaccgcttcgccagcgccctgaccgccctcaacgacatgggcaaggtccggaaggacatccagcagtgggagccctcccgcgggtggaacgactggacccaggtcccgttctgcagccaccacttccacgagctggtgatgaaggacggccgggtcctggtggtgccctgccgcaaccaggacgagctcatcgggcgggcgcgcatctcccagggcgccggctggagcctgaaggagaccgcctgcctggggaagtcctacgcccagatgtggaccctcatgtacttccaccggcgcgacctgcggctggccgcgaacgccatctgcagcgccgtgccgccccactgggtgccgacctcccgcaccacgtggagcatccacgccaagcacgagtggatgaccaccgaggacatgctcgcggtgtggaaccgggtctggatccaggagaacccctggatggaggacaagacccccgtggagtcctgggaggaggtgccctacctgggcaagcgcgaggaccagtggtgcgggagcctgatcggcctcacgtcccgggccacctgggccaagaacatccagaccgccatcaaccaggtccgcagcctgatcgggaacgaggagtacaccgactacatgccgagcatgaagcgcttccggcgcgaggaggaggaggccggcgtgctgtggtga

SEQ ID NO: 9241 - RNA, 9876 nt, synthetic construct
  misc_feature 1..9876: note = derived and/or modified CDS sequence (opt1) from DENV-2__FJ744745__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgaagatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcgcatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccggtccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgacatccgcgggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtcctcaagatcgtgcgcaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgccatcgcgcagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcaccctgatcctcgccccgacgcgcgtggtggcggccgagatggaggaggccctgcggggcctgcccatccgctaccagacccccgccatcaagaccgagcacaccgggcgggagatcgtcgacctcatgtgccacgccacgttcaccatgcgcctgctgagccccgtgcgggtgccgaactacaacctcatcatcatggacgaggcgcacttcaccgaccccgcctccatcgccgcccgcggctacatcagcacccgggtcgagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggccgagcgcgtgatcgacccccggcgctgcatgaagcccgtcatcctcacggacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagaccttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtgctgcacaccgccgaggccgggggccgcgcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcacgctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccgcccggccagcgcctggacgctgtacgccgtggcgaccaccttcgtgacccccatgctgcggcactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacgcgcgaggcccagaagcgggccgccgcgggcatcatgaagaaccccaccgtcgacgggatcaccgtgatcgacctcgagcccatcccgtacgaccccaagttcgagaagcagctgggccaggtgatgctgctcatcctgtgcgtcacccaggtgctgatgatgcgcacgacctgggccctctgcgaggccctgaccctggccaccgggcccatctccacgctctgggagggcaaccccgggcggttctggaacaccaccatcgccgtgagcatggcgaacatcttccgcggctcctacctggccggcgccgggctcctgttcagcatcatgaagaacaccacgaacacccgccggggcaccgggaacatcggcgagaccctgggcgagaagtggaagtcccgcctgaacgccctcggcaagagcgagttccagatctacaagaagtccggcatccaggaggtcgaccggacgctggcgaaggaggggatcaagcgcggcgagaccgaccaccacgccgtgagccgggggtccgccaagctgcgctggttcgtggagcggaacatggtcaccccggagggcaaggtggtggacctcggctgcgggcgcggcgggtggagctactactgcggcgggctgaagaacgtccgggaggtgaagggcctgaccaagggcgggcccggccacgaggagcccatccccatgtccacgtacgggtggaacctcgtgcgcctgcagagcggcgtcgacgtgttcttcaccccgcccgagaagtgcgacaccctgctctgcgacatcggggagagctcccccaaccccaccatcgaggccggccggaccctgcgcgtgctgaacctcgtcgagaactggctgaacaacaacacgcagttctgcatcaaggtgctgaacccgtacatgcccagcgtgatcgagaagatggaggccctccagcggaagtacggcggggcgctggtccgcaaccccctgtcccggaacagcacccacgagatgtactgggtgtccaacgccagcggcaacatcgtgtccagcgtcaacatgatctcccgcatgctgatcaaccggttcaccatgaagcacaagaaggccacctacgagccggacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtggtcccgatggtgacccagatggcgatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagacgccccgcatgtgcacccgggaggagttcacgcgcaaggtgcggtccaacgccgccctgggggccatcttcaccgacgagaacaagtggaagtccgcgcgcgaggccgtggaggactcccggttctgggagctggtcgaccgcgagcggaacctccacctggagggcaagtgcgagacctgcgtgtacaacatgatggggaagcgcgagaagaagctgggcgagttcgggaaggccaagggcagccgggccatctggtacatgtggctcggcgcgcgcttcctggagttcgaggccctggggttcctcaacgaggaccactggttcagccggggcaactccctgagcggggtggagggcgaggggctgcaccgcctcggctacatcctgcgggacgtcggcaagaaggagggcggcgccatgtacgccgacgacaccgccgggtgggacacgcgcatcaccctggaggacctcaagaacgaggagatggtgaccaaccacatgaagggcgagcacaagaagctggcggaggccatcttcaagctgacctaccagaacaaggtcgtgcgggtgcagcgcccgacgccccgggggaccgtcatggacatcatctcccgccgggaccagcgcggcagcggccaggtggggacctacggcctcaacaccttcacgaacatggaggcccagctgatccgccagatggagggggagggcatcttcaagtccatccagcacctgaccgccaccgaggagatcgccgtgcagaactggctcgcgcgggtcggccgcgagcggctgagccgcatggccatctccggggacgactgcgtggtgaagcccatcgacgaccggttcgccagcgccctgaccgccctcaacgacatgggcaaggtccgcaaggacatccagcagtgggagccctcccgggggtggaacgactggacccaggtcccgttctgcagccaccacttccacgagctggtgatgaaggacggccgcgtcctggtggtgccctgccggaaccaggacgagctcatcgggcgcgcgcggatctcccagggcgccggctggagcctgaaggagaccgcctgcctggggaagtcctacgcccagatgtggaccctcatgtacttccaccgccgggacctgcgcctggccgcgaacgccatctgcagcgccgtgccgccccactgggtgccgacctcccggaccacgtggagcatccacgccaagcacgagtggatgaccaccgaggacatgctcgcggtgtggaaccgcgtctggatccaggagaacccctggatggaggacaagacccccgtggagtcctgggaggaggtgccctacctgggcaagcgggaggaccagtggtgcgggagcctgatcggcctcacgagccgcgccacctgggccaagaacatccagaccgccatcaaccaggtccggtccctgatcgggaacgaggagtacaccgactacatgccgagcatgaagcgcttccgccgggaggaggaggaggccggcgtgctgtggtga

SEQ ID NO: 9242 - RNA, 9876 nt, synthetic construct
  misc_feature 1..9876: note = derived and/or modified CDS sequence (opt1) from DENV-2__FJ744705__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacgactccccctgcaagatccccttcgagatcaccgacctggagaagcggcacgtgctcggccgcctgatcaccgtgaacccgatcgtcaccgagaaggacagccccgtgaacatcgaggcggagccgcccttcggggactcctacatcatcatcggcgtggagccggggcagctgaagctcaactggttcaagaagggcagctccatcgggcagatgttcgagacgaccatgcgcggcgccaagcggatggccatcctgggcgacaccgcctgggacttcgggagcctgggcggggtcttcacctccatcggcaaggccctccaccaggtgttcggggcgatctacggcgccgccttcagcggcgtgtcctggacgatgaagatcctgatcggggtcatcatcacctggatcggcatgaacagccgctccaccagcctgtccgtgagcctggtgctcgtcggggtggtgaccctgtacctgggcgccatggtccaggcggactccgggtgcatcgtgagctggaagaacaaggagctcaagtgcggctccggcatcttcatcacggacaacgtgcacacctggaccgagcagtacaagttccagcccgagagccccagcaagctggcctccgccatccagaaggcccacgaggaggggatctgcggcatccggagcgtcacccgcctggagaacctcatgtggaagcagatcacgcccgagctgaaccacatcctgtccgagaacgaggtgaagctcaccatcatgaccggggacatccggggcatcatgcaggccgggaagcgcagcctgcggccgcagcccaccgagctgaagtactcctggaagacgtggggcaaggcgaagatgctcagcaccgagtcccacaaccagaccttcctgatcgacggccccgagaccgtggagtgcccgaacacgaaccgcgcctggaacagcctggaggtcgaggactacgggttcggcgtgttcaccaccaacatctggctcaagctgcgggagaagcaggacgtgttctgcgactccaagctgatgagcgccgccatcaaggacaaccgcgccgtccacgcggacatggggtactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccggccccgtctcccagcacaactaccggccggggtaccacacgcagaccgccggcccctggcacctcgggaagctggagatggacttcgacctgtgcgagggcaccaccgtggtggtcacggaggactgcgggaaccgcggccccagcctccggaccaccaccgcgagcggcaagctgatcacggagtggtgctgccgctcctgcaccctgcccccgctccggtaccgcggggaggacggctgctggtacgggatggagatccggcccctgaaggagaaggaggagaacctggtgaacagcctcgtgaccgccggccacgggcagatcgacaacttctccctgggcgtcctgggcatggccctcttcctggaggagatgctgcgcacccggatcgggacgaagcacgccatcctcctggtggcggtgagcttcgtcaccctgatcaccggcaacatgtccttccgcgacctcgggcgcgtgatggtgatggtcggcgccaccatgacggacgacatcgggatgggcgtgacctacctggccctgctcgccgccttcaaggtgcggcccaccttcgcggccggcctgctgctccgcaagctgaccagcaaggagctgatgatggccacgatcgggatcgccctcctgtcccagagcaccatccccgagaccatcctggagctcaccgacgccctggcgctgggcatgatggtcctcaagatcgtgcggaacatggagaagtaccagctggccgtgacgatcatggccatctcctgcgtcccgaacgccgtgatcctgcagaacgcctggaaggtgagctgcaccatcctcgcggccgtctccgtgagccccctgctgctcacctccagccagcagaaggccgactggatccccctggccctgaccatcaaggggctcaaccccacggcgatcttcctgaccaccctgtcccgcaccagcaagaagcggtcctggccgctcaacgaggccatcatggccgtcggcatggtgagcatcctggcctccagcctgctcaagaacgacatccccatgacgggccccctggtggccgggggcctgctcaccgtctgctacgtgctgaccgggcgcagcgcggacctggagctcgagcgggccgccgacgtgaagtgggaggaccaggccgagatctccggcagctcccccatcctgagcatcaccatctccgaggacgggagcatgtccatcaagaacgaggaggaggagcagacgctgaccatcctcatccgcaccggcctgctggtcatcagcggcgtgttcccggtgtccatccccatcaccgccgcggcctggtacctctgggaggtcaagaagcagcgggccggggtgctgtgggacgtgcccagcccgccgcccgtcgagaaggccgagctggaggacggcgcctaccgcatcaagcagcgggggatcctcggctactcccagatcggggcgggcgtgtacaaggagggcaccttccacacgatgtggcacgtgacccgcggggccgtcctgatgcaccggggcaagcgcatcgagcccagctgggccgacgtgaagaaggacctgatctcctacgggggcgggtggaagctcgagggcgagtggaaggagggcgaggaggtgcaggtcctggccctggagcccgggaagaacccccgggccgtgcagaccaagcccggcatcttcaagaccaacacggggaccatcggcgcggtgagcctcgacttctcccccgggaccagcggctcccccatcgtcgaccgcaagggcaaggtggtggggctgtacggcaacggggtcgtgacccggagcggcgcctacgtgtccgccatcgcccagacggagaagtccatcgaggacaaccccgagatcgaggacgacatcttccgcaagaagcggctgaccatcatggacctccaccccggcgcggggaagaccaagcgctacctgcccgccatcgtccgggaggccatcaagcgcggcctgcgcaccctgatcctcgccccgacgcgggtggtggccgcggagatggaggaggccctgcgcgggctgcccatccggtaccagacccccgccatcaagaccgagcacaccggccgcgagatcgtcgacctcatgtgccacgccacgttcaccatgcggctgctgagccccgtgcgcgtgccgaactacaacctcatcatcatggacgaggcccacttcaccgaccccgcgtccatcgccgcccgggggtacatcagcacccgcgtcgagatgggcgaggccgccggcatcttcatgacggcgacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgccgcgtgcctgcgcaagaacgggaagaaggtgatccagctgagccggaagacgttcgactccgagtacgtgaagacccgcgccaacgactgggacttcgtcgtgaccaccgacatcagcgagatgggcgccaacttcaaggccgagcgggtgatcgacccccgccggtgcatgaagcccgtcatcctcacggacggcgaggagcgcgtgatcctggccgggcccatgccggtgacccactccagcgcggcccagcggcgcggccgcatcgggcggaaccccaagaacgagaacgaccagtacatctacatgggcgagcccctggagaacgacgaggactgcgcccactggaaggaggccaagatgctcctggacaacatcaacacccccgaggggatcatcccgtccatgttcgagcccgagcgcgagaaggtcgacgccatcgacggcgagtaccggctgcgcggcgaggcgcggaagaccttcgtggacctcatgcgccgcggggacctgcccgtgtggctggcctacaaggtcgccgccgagggcatcaactacgccgaccgcaagtggtgcttcgacgggatcaagaacaaccagatcctcgaggagaacatggaggtggagatctggacgaaggagggcgagcggaagaagctgaagccgcgctggctggacgcgcggatctacagcgaccccctcgccctgaaggagttcaaggagttcgccgccgggcgcaagtccctgaccctcaacctgatcaccgagatgggccggctgcccaccttcatgacgcagaaggcgcgcaacgccctcgacaacctggccgtgctgcacaccgccgaggccggcgggcgggcgtacaaccacgccctcagcgagctgcccgagaccctggagaccctcctgctgctcacgctgctggccaccgtcaccggcgggatcttcctcttcctgatgtccggcaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcgcacgccccaggacaaccagctcacctacgtcgtgatcgccatcctgaccgtggtcgccgccaccatggcgaacgagatggggttcctggagaagacgaagaaggacctcggcctggggagcatcaccacccaggagagcgagtccaacatcctggacatcgacctccggccggccagcgcctggaccctgtacgccgtggccacgaccttcgtgacccccatgctgcgccactccatcgagaacagctccgtcaacgtgagcctcaccgcgatcgccaaccaggccacggtgctgatgggcctgggcaaggggtggcccctctccaagatggacatcggcgtccccctgctggccatcgggtgctacagccaggtgaacccgatcaccctcaccgcggccctgctgctcctggtggcccactacgccatcatcggccccgggctgcaggccaaggcgacccgggaggcccagaagcgcgccgccgccggcatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcggaccacgtgggcgctctgcgaggccctgaccctggccaccggccccatctccaccctctgggaggggaaccccggccgcttctggaacacgaccatcgccgtgagcatggccaacatcttccgcgggtcctacctggcgggcgccggcctcctcttcagcatcatgaagaacaccaccaacacgcggcgcgggaccggcaacatcggggagaccctgggcgagaagtggaagtcccggctgaacgccctcggcaagagcgagttccagatctacaagaagtccgggatccaggaggtcgaccgcaccctggccaaggagggcatcaagcgcggggagacggaccaccacgcggtgagccgcggctccgccaagctgcggtggttcgtggagcgcaacatggtcaccccggaggggaaggtggtggacctcggctgcggccgcggcgggtggagctactactgcggcgggctgaagaacgtccgcgaggtgaaggggctgaccaagggcgggcccgggcacgaggagcccatccccatgtccacctacggctggaacctcgtgcggctgcagagcggggtcgacgtgttcttcacgccgcccgagaagtgcgacaccctgctctgcgacatcggcgagagctcccccaaccccaccatcgaggccgggcgcaccctgcgggtgctgaacctcgtcgagaactggctgaacaacaacacccagttctgcatcaaggtgctgaacccgtacatgcccagcgtgatcgagaagatggaggccctccagcgcaagtacggcggcgccctggtccggaaccccctgtcccgcaacagcacgcacgagatgtactgggtgtccaacgcgaccgggaacatcgtgagctccgtcaacatgatcagccggatgctgatcaaccgcttcaccatgaagcacaagaaggccacctacgagccggacgtggacctcggctccgggacgcggaacatcggcatcgagagcgagatccccaacctggacatcatcgggaagcgcatcgagaagatcaagcaggagcacgagacctcctggcactacgaccaggaccacccctacaagacctgggcctaccacggcagctacgagaccaagcagacgggctccgccagctccatggtgaacggggtcgtgcgcctgctcaccaagccctgggacgtggtcccgatggtgacccagatggccatgaccgacacgacccccttcggccagcagcgggtgttcaaggagaaggtcgacacccgcacccaggagcccaaggaggggacgaagaagctgatgaagatcaccgcggagtggctgtggaaggagctcggcaagaagaagacgccccggatgtgcacccgcgaggagttcacgcggaaggtgcgcagcaacgccgccctgggcgccatcttcaccgacgagaacaagtggaagtccgcccgggaggcggtggaggacgggcgcttctgggagctggtcgaccgggagcgcaacctccacctggagggcaagtgcgagacctgcgtgtacaacatgatggggaagcgggagaagaagctgggcgagttcgggaaggccaagggcagccgcgccatctggtacatgtggctcggcgcccggttcctggagttcgaggcgctggggttcctcaacgaggaccactggttctcccgcggcaacagcctgagcggggtggagggcgaggggctgcaccggctcggctacatcctgcgcgacgtcggcaagaaggagggcggcgccatgtacgccgacgacaccgccgggtgggacacgcggatcaccctggaggacctcaagaacgaggagatggtgaccaaccacatgaagggcgagcacaagaagctggccgaggcgatcttcaagctgacctaccagaacaaggtcgtgcgcgtgcagcggccgacgccccgcgggaccgtcatggacatcatctcccggcgcgaccagcgcggcagcggccaggtggggacctacggcctcaacaccttcacgaacatggaggcccagctgatccggcagatggagggggagggcatcttcaagtccatccagcacctgaccgccaccgaggagatcgccgtgcagaactggctcgcccgcgtcggccgggagcgcctgagccggatggcgatctccggggacgactgcgtggtgaagcccatcgacgaccgcttcgccagcgccctgaccgccctcaacgacatgggcaaggtccggaaggacatccagcagtgggagccctcccgcgggtggaacgactggacccaggtcccgttctgcagccaccacttccacgagctggtgatgaaggacggccgggtcctggtggtgccctgccgcaaccaggacgagctcatcgggcgggcccgcatctcccagggcgcgggctggagcctgaaggagaccgcctgcctggggaagtcctacgcccagatgtggaccctcatgtacttccaccggcgcgacctgcggctggccgccaacgcgatctgcagcgccgtgccgccccactgggtgccgacctcccgcaccacgtggagcatccacgccaagcacgagtggatgaccaccgaggacatgctcgccgtgtggaaccgggtctggatccaggagaacccctggatggaggacaagacccccgtggagtcctgggaggaggtgccctacctgggcaagcgcgaggaccagtggtgcgggagcctgatcggcctcacgtcccgggcgacctgggccaagaacatccagaccgccatcaaccaggtccgcagcctgatcgggaacgaggagtacaccgactacatgccgagcatgaagcgcttccggcgcgaggaggaggaggccggcgtgctgtggtga

SEQ ID NO: 9243 - RNA, 9876 nt, synthetic construct
  misc_feature 1..9876: note = derived and/or modified CDS sequence (opt1) from DENV-2__FJ744744__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgaagatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcgcatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccggtccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgacatccgcgggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgtcgggctgctgctccggaagctgaccagcaaggagctgatgatggccacgatcggcatcgccctcctgtcccagagcaccatccccgagaccatcctggagctcaccgacgccctggcgctggggatgatggtgctcaagatcgtgcgcaacatggagaagtaccagctggccgtcacgatcatggccatctcctgcgtgccgaacgccgtgatcctgcagaacgcctggaaggtcagctgcaccatcctcgcggtggtctccgtgagccccctgctgctcacctccagccagcagaaggccgactggatccccctggccctgaccatcaagggcctcaaccccacggccatcttcctgaccaccctgtcccggaccagcaagaagcgctcctggccgctcaacgaggcgatcatggccgtgggcatggtcagcatcctggcctccagcctgctcaagaacgacatccccatgacggggcccctggtggccggcgggctgctcaccgtgtgctacgtcctgaccggccggagcgccgacctggagctcgagcgcgcggccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtgatcagcggggtcttcccggtgtccatccccatcaccgccgccgcgtggtacctctgggaggtgaagaagcagcgcgccggcgtcctgtgggacgtgcccagcccgccgcccgtggagaaggccgagctggaggacggggcctaccggatcaagcagcgcggcatcctcgggtactcccagatcggcgccggcgtctacaaggaggggaccttccacacgatgtggcacgtgacccggggcgcggtgctgatgcaccgcgggaagcggatcgagcccagctgggccgacgtcaagaaggacctgatctcctacggcgggggctggaagctcgagggcgagtggaaggagggggaggaggtccaggtgctggccctggagcccggcaagaacccccgcgccgtccagaccaagcccgggatcttcaagaccaacacgggcaccatcggggccgtgagcctcgacttctcccccggcaccagcggctcccccatcgtggaccggaaggggaaggtcgtgggcctgtacgggaacggcgtggtcacccgcagcggcgcgtacgtgtccgccatcgcccagacggagaagtccatcgaggacaaccccgagatcgaggacgacatcttccggaagaagcgcctgaccatcatggacctccaccccggggccggcaagaccaagcggtacctgcccgcgatcgtgcgcgaggccatcaagcgggggctgcgcaccctgatcctcgccccgacgcgcgtcgtggccgccgagatggaggaggcgctgcggggcctgcccatccgctaccagacccccgccatcaagaccgagcacaccgggcgggagatcgtggacctcatgtgccacgccacgttcaccatgcgcctgctgagccccgtccgggtgccgaactacaacctcatcatcatggacgaggcccacttcaccgaccccgcctccatcgcggcccgcggctacatcagcacccgggtggagatgggcgaggccgccgggatcttcatgacggccacgccgcccggctcccgcgacccgttcccccagagcaacgcgcccatcatggacgaggagcgggagatccccgagcgctcctggaacagcgggcacgagtgggtcaccgacttcaagggcaagaccgtgtggttcgtgccgtccatcaaggccgggaacgacatcgccgcctgcctgcggaagaacggcaagaaggtcatccagctgagccgcaagacgttcgactccgagtacgtgaagacccgggcgaacgactgggacttcgtggtcaccaccgacatcagcgagatgggcgccaacttcaaggccgagcgcgtgatcgacccccggcgctgcatgaagcccgtgatcctcacggacggggaggagcgggtcatcctggccggccccatgccggtgacccactccagcgccgcgcagcgccgggggcgcatcggccgcaaccccaagaacgagaacgaccagtacatctacatgggggagcccctggagaacgacgagaactgcgcccactggaaggaggccaagatgctcctggacaacatcaacacccccgagggcatcatcccgtccatgttcgagcccgagcgggagaaggtggacgccatcgacggcgagtaccgcctgcgcggggaggcccgcaagaccttcgtcgacctcatgcggcgcggcgacctgcccgtgtggctggcgtacaaggtggccgccgaggggatcaactacgccgaccggaagtggtgcttcgacggcatcaagaacaaccagatcctcgaggagaacatggaggtcgagatctggacgaaggagggggagcgcaagaagctgaagccgcggtggctggacgcccgcatctacagcgaccccctcgcgctgaaggagttcaaggagttcgccgccggccggaagtccctgaccctcaacctgatcaccgagatgggccgcctgcccaccttcatgacgcagaaggcccggaacgcgctcgacaacctggccgtgctgcacaccgccgaggccgggggccgcgcctacaaccacgcgctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcccagatccagccgcactggatcgccgcgtccatcatcctggagttcttcctcatcgtgctgctgatccccgagcccgagaagcagcggacgccccaggacaaccagctcacctacgtggtcatcgccatcctgaccgtggtggccgccaccatggccaacgagatgggcttcctggagaagacgaagaaggacctcgggctgggcagcatcaccacccaggagagcgagtccaacatcctggacatcgacctccgcccggcgagcgcctggaccctgtacgccgtcgccacgaccttcgtgacccccatgctgcggcactccatcgagaacagctccgtgaacgtcagcctcaccgccatcgcgaaccaggccacggtgctgatgggcctggggaagggctggcccctctccaagatggacatcggggtgcccctgctggccatcggctgctacagccaggtcaacccgatcaccctcaccgccgcgctgctgctcctggtggcccactacgccatcatcgggcccggcctgcaggccaaggccacccgcgaggcgcagaagcgggccgccgccggcatcatgaagaaccccacggtggacgggatcaccgtcatcgacctcgagcccatcccgtacgaccccaagttcgagaagcagctgggccaggtgatgctgctcatcctgtgcgtgacccaggtcctgatgatgcgcaccacgtgggccctctgcgaggcgctgaccctggccaccgggcccatctccaccctctgggagggcaaccccgggcggttctggaacacgaccatcgccgtgagcatggccaacatcttccgcggctcctacctggccggcgcggggctcctgttcagcatcatgaagaacaccaccaacacgcgccggggcaccgggaacatcggcgagaccctgggcgagaagtggaagtcccgcctgaacgccctcggcaagagcgagttccagatctacaagaagtccggcatccaggaggtggaccggaccctggccaaggaggggatcaagcgcggcgagacggaccaccacgccgtcagccgggggtccgcgaagctgcgctggttcgtggagcggaacatggtgaccccggagggcaaggtcgtggacctcggctgcgggcgcggcgggtggagctactactgcggcgggctgaagaacgtgcgggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagagctcccccaaccccaccatcgaggccggccggaccctgcgcgtgctgaacctcgtggagaactggctgaacaacaacacccagttctgcatcaaggtcctgaacccgtacatgcccagcgtgatcgagaagatggaggccctccagcggaagtacggcggggccctggtgcgcaaccccctgtcccggaacagcacgcacgagatgtactgggtctccaacgccagcggcaacatcgtgtccagcgtgaacatgatctcccgcatgctgatcaaccggttcaccatgaagcacaagaaggcgacctacgagccggacgtcgacctcgggagcggcacccgcaacatcgggatcgagtccgagatccccaacctggacatcatcggcaagcggatcgagaagatcaagcaggagcacgagacgagctggcactacgaccaggaccacccctacaagacctgggcctaccacggctcctacgagaccaagcagaccgggagcgcctccagcatggtgaacggcgtggtccgcctgctcacgaagccctgggacgtggtgccgatggtcacccagatggccatgaccgacaccacgcccttcgggcagcagcgcgtgttcaaggagaaggtggacacccggacccaggagcccaaggagggcaccaagaagctgatgaagatcacggccgagtggctgtggaaggagctcggcaagaagaagacgccccgcatgtgcacccgggaggagttcacccgcaaggtccggtccaacgcggccctgggggccatcttcacggacgagaacaagtggaagtccgcccgcgaggccgtggaggactcccggttctgggagctggtggaccgcgagcggaacctccacctggagggcaagtgcgagacctgcgtctacaacatgatggggaagcgcgagaagaagctgggcgagttcgggaaggcgaagggcagccgggccatctggtacatgtggctcggcgcccgcttcctggagttcgaggccctggggttcctcaacgaggaccactggttcagccggggcaactccctgagcggggtggagggcgaggggctgcaccgcctcggctacatcctgcgggacgtcggcaagaaggagggcggcgcgatgtacgccgacgacaccgccgggtgggacacccgcatcacgctggaggacctcaagaacgaggagatggtgaccaaccacatgaagggcgagcacaagaagctggccgaggccatcttcaagctgacctaccagaacaaggtggtccgggtgcagcgcccgacgccccgggggacggtgatggacatcatctcccgccgggaccagcgcggcagcggccaggtcgggacctacggcctcaacaccttcaccaacatggaggcgcagctgatccgccagatggagggggagggcatcttcaagtccatccagcacctgacggccaccgaggagatcgccgtgcagaactggctcgcccgggtgggccgcgagcggctgagccgcatggccatctccggggacgactgcgtcgtgaagcccatcgacgaccggttcgcgagcgccctgaccgccctcaacgacatgggcaaggtgcgcaaggacatccagcagtgggagccctcccgggggtggaacgactggacccaggtcccgttctgcagccaccacttccacgagctggtgatgaaggacggccgcgtgctggtcgtgccctgccggaaccaggacgagctcatcgggcgcgcccggatctcccagggcgccggctggagcctgaaggagacggcgtgcctggggaagtcctacgcccagatgtggaccctcatgtacttccaccgccgggacctgcgcctggccgccaacgccatctgcagcgcggtgccgccccactgggtcccgacctcccggaccacctggagcatccacgccaagcacgagtggatgacgaccgaggacatgctcgccgtgtggaaccgcgtgtggatccaggagaacccctggatggaggacaagacccccgtcgagtcctgggaggaggtgccctacctgggcaagcgggaggaccagtggtgcgggagcctgatcggcctcaccagccgcgccacgtgggcgaagaacatccagaccgccatcaaccaggtgcggtccctgatcgggaacgaggagtacaccgactacatgccgagcatgaagcgcttccgccgggaggaggaggaggccggcgtcctgtggtga

SEQ ID NO: 9244 - RNA, 9876 nt, synthetic construct
  misc_feature 1..9876: note = derived and/or modified CDS sequence (opt1) from DENV-2__GQ868646__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgaagttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggacaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcctgctggaggagatgctccgcacccggatcggcacgaagcacgcgatcctgctggtggccgtgagcttcgtcaccctcatcaccgggaacatgtccttccgcgacctgggccgcgtgatggtgatggtcggggccaccatgacggacgacatcggcatgggcgtgacctacctggccctcctggccgcgttcaaggtgcggcccaccttcgccgccgggctgctcctgcgcaagctgaccagcaaggagctcatgatggccacgatcggcatcgccctgctgtcccagagcaccatccccgagaccatcctcgagctgaccgacgcgctggccctcgggatgatggtcctgaagatcgtgcggaacatggagaagtaccagctggccgtgacggtcatggccatctcctgcgtgccgaacgccgtgatcctccagaacgcgtggaaggtcagctgcaccatcctggccgccgtgtccgtcagccccctgctcctgacctccagccagcagaaggccgactggatccccctggcgctcaccatcaagggcctgaaccccacggccatcttcctgaccaccctctcccgcaccagcaagaagcggtcctggccgctgaacgaggccatcatggccgtgggcatggtgagcatcctggcctccagcctcctgaagaacgacatccccatgacggggcccctggtcgcgggcgggctcctgaccgtgtgctacgtgctgaccggccgcagcgccgacctcgagctggagcgggccgccgacgtcaagtgggaggaccaggccgagatctccgggagctcccccatcctgagcatcaccatctccgaggacggcagcatgtccatcaagaacgaggaggaggagcagacgctcaccatcctgatccgcaccggcctgctcgtgatcagcggggtgttcccggtctccatccccatcaccgcggccgcctggtacctgtgggaggtgaagaagcagcgggccggcgtgctgtgggacgtccccagcccgccgcccgtggagaaggccgagctcgaggacggggcgtaccgcatcaagcagcggggcatcctggggtactcccagatcggcgccggcgtgtacaaggaggggaccttccacacgatgtggcacgtcacccgcggcgccgtgctgatgcaccgggggaagcgcatcgagcccagctgggccgacgtgaagaaggacctcatctcctacggcgggggctggaagctggagggcgagtggaaggagggggaggaggtccaggtgctggccctcgagcccggcaagaacccccgggcggtgcagaccaagcccgggatcttcaagaccaacacgggcaccatcggggccgtcagcctggacttctcccccggcaccagcggctcccccatcgtggaccgcaaggggaaggtggtcggcctgtacgggaacggcgtggtgacccggagcggcgcctacgtctccgccatcgcgcagacggagaagtccatcgaggacaaccccgagatcgaggacgacatcttccgcaagaagcggctcaccatcatggacctgcaccccggggccggcaagaccaagcgctacctgcccgccatcgtgcgggaggccatcaagcgcgggctgcgcaccctcatcctggccccgacgcgggtggtcgcggccgagatggaggaggccctgcgcggcctccccatccggtaccagaccaccgccatcaagaccgagcacacggggcgcgagatcgtggacctgatgtgccacgccaccttcaccatgcggctgctcagccccgtgcgcgtccccaactacaacctgatcatcatggacgaggcgcacttcaccgacccggcctccatcgccgcccggggctacatcagcacgcgcgtggagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtctggttcgtgccctccatcaaggccgggaacgacatcgcggcctgcctgcgcaagaacggcaagaaggtgatccagctcagccggaagaccttcgactccgagtacgtcaagacccgcgccaacgactgggacttcgtggtgaccacggacatcagcgagatgggcgccaacttcaaggccgagcgggtcatcgacccgcgccggtgcatgaagcccgtgatcctgaccgacggggaggagcgcgtgatcctggcgggccccatgcccgtcacccactccagcgccgcccagcggcgcgggcgcatcggccggaacccgaagaacgagaacgaccagtacatctacatgggggagcccctcgagaacgacgaggactgcgcccactggaaggaggccaagatgctgctggacaacatcaacacccccgagggcatcatcccctccatgttcgagccggagcgcgagaaggtggacgcgatcgacggcgagtaccggctccgcggggaggcccggaagacgttcgtggacctgatgcgccggggcgacctgcccgtctggctcgcctacaaggtggccgccgaggggatcaactacgcggaccgcaagtggtgcttcgacggcatcaagaacaaccagatcctggaggagaacatggaggtggagatctggaccaaggagggggagcggaagaagctgaagccccgctggctcgacgcccggatctacagcgacccgctggccctgaaggagttcaaggagttcgccgcgggccgcaagtccctcaccctgaacctgatcaccgagatgggccggctccccacgttcatgacccagaaggcccgcaacgccctggacaacctggccgtcctccacaccgccgaggccgggggccgggcctacaaccacgccctgagcgagctgcccgagaccctcgagacgctgctgctcctgaccctgctcgccaccgtgaccgggggcatcttcctgttcctgatgtccggcaaggggatcggcaagatgaccctcgggatgtgctgcatcatcacggccagcatcctgctgtggtacgcgcagatccagccccactggatcgccgcctccatcatcctcgagttcttcctgatcgtcctgctcatcccggagcccgagaagcagcgcacgccccaggacaaccagctgacctacgtggtgatcgccatcctgaccgtcgtggccgcgacgatggccaacgagatgggcttcctcgagaagaccaagaaggacctggggctgggcagcatcaccacccaggagagcgagtccaacatcctcgacatcgacctgcggcccgccagcgcctggacgctgtacgccgtggcgaccaccttcgtcaccccgatgctccgccactccatcgagaacagctccgtgaacgtgagcctgacggccatcgccaaccaggccaccgtcctgatgggcctcgggaagggctggcccctgtccaagatggacatcggggtgcccctgctcgcgatcggctgctacagccaggtgaaccccatcaccctgaccgccgccctgctcctgctggtcgcccactacgccatcatcgggccgggcctccaggcgaaggccacgcgggaggcccagaagcgcgccgccgcgggcatcatgaagaaccccaccgtggacgggatcaccgtgatcgacctggagcccatcccctacgacccgaagttcgagaagcagctgggccaggtcatgctcctgatcctgtgcgtgacccaggtgctcatgatgcggacgacctgggccctgtgcgaggccctgaccctcgccaccgggcccatctccacgctgtgggagggcaaccccgggcgcttctggaacaccaccatcgccgtcagcatggcgaacatcttccgcggctcctacctggccggcgccgggctcctgttcagcatcatgaagaacaccacgaacacccggcgcggcaccgggaacatcggcgagaccctgggcgagaagtggaagtcccggctcaacgccctgggcaagagcgagttccagatctacaagaagtccggcatccaggaggtggaccgcacgctggcgaaggaggggatcaagcggggcgagaccgaccaccacgccgtgagccgcgggtccgccaagctccggtggttcgtcgagcgcaacatggtgacccccgagggcaaggtggtcgacctgggctgcgggcggggcgggtggagctactactgcggcgggctgaagaacgtgcgcgaggtgaagggcctcaccaagggcgggccgggccacgaggagcccatccccatgtccacgtacgggtggaacctggtccggctgcagagcggcgtggacgtgttcttcacgccgcccgagaagtgcgacaccctcctgtgcgacatcggggagagctcccccaaccccaccatcgaggccggccgcaccctgcgggtcctcaacctggtggagaactggctgaacaacaacacgcagttctgcatcaaggtgctcaacccctacatgcccagcgtcatcgagaagatggaggccctgcagcgcaagtacggcggggcgctggtgcggaaccccctgtcccgcaacagcacccacgagatgtactgggtgtccaacgccaccggcaacatcgtcagctccgtgaacatgatcagccggatgctcatcaaccgcttcaccatgaagcacaagaaggccacgtacgagcccgacgtggacctggggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtcaacggcgtggtgcgcctcctgaccaagccctgggacgtcgtgcccatggtgacccagatggcgatgacggacaccaccccgttcgggcagcagcgggtcttcaaggagaaggtggacacccgcacgcaggagcccaaggagggcaccaagaagctgatgaagatcaccgccgagtggctctggaaggagctgggcaaggagaagacgccccggatgtgcacgcgcgaggagttcacccggaaggtgcgcagcaacgccgccctgggggccatcttcaccgacgagaacaagtggaagtccgcgcgggaggccgtcgaggacggccgcttctgggagctcgtggaccgggagcgcaacctgcacctggaggggaagtgcgagacctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgggaacagcctgagcggcgtcgagggggagggcctccaccggctgggctacatcctgcgcgacgtggggaagaaggagggcggggccatgtacgccgacgacacggccggctgggacacccggatcaccctcgaggacctgaagaacgaggagatggtcaccaaccacatgaagggggagcacaagaagctggcggaggccatcttcaagctcacgtaccagaacaaggtggtgcgcgtccagcggcccaccccgcgcggcaccgtgatggacatcatctcccggcgcgaccagcgcggcagcgggcaggtcggcacctacgggctgaacacgttcaccaacatggaggcccagctgatccggcagatggagggcgagggcatcttcaagtccatccagcacctcaccgccaccgaggagatcgccgtccagaactggctggcgcgcgtggggcgggagcgcctgagccggatggccatctccggcgacgactgcgtggtcaagcccatcgacgaccgcttcgccagcgccctcacggccctgaacgacatggggaaggtgcggaaggacatccagcagtgggagccctcccgcggctggaacgactggacccaggtgcccttctgcagccaccacttccacgagctggtcatgaaggacgggcgggtgctcgtggtcccgtgccgcaaccaggacgagctgatcggccgggcgcgcatctcccagggcgccgggtggagcctgaaggagaccgcctgcctcggcaagtcctacgcccagatgtggaccctgatgtacttccaccggcgcgacctgcggctcgccgcgaacgccatctgcagcgccgtgccctcccactgggtgcccaccagccgcacgacctggtccatccacgccaagcacgagtggatgaccaccgaggacatgctggcggtctggaaccgggtgtggatccaggagaacccctggatggaggacaagacgccggtggagagctgggaggaggtcccctacctggggaagcgcgaggaccagtggtgcggctccctcatcgggctgaccagccgggccacctgggccaagaacatccagaccgccatcaaccaggtgcgcagcctgatcggcaacgaggagtacacggactacatgccctccatgaagcgcttccggcgcgaggaggaggaggccggcgtgctctggtga

SEQ ID NO: 9245 - RNA, 9876 nt, synthetic construct
  misc_feature 1..9876: note = derived and/or modified CDS sequence (opt1) from DENV-2__FJ906961__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccaccccggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagccccacaaccagaccttcctgatcgacgggccggagaccgccgagtgccccaacacgaaccgcgcctggaactccctggaggtcgaggactacggcttcggggtgttcaccaccaacatctggctcaagctgcgggagaagcaggaggtgttctgcgacagcaagctgatgtccgccgccatcaaggacaaccgcgcggtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggccggtgagccagcacaactaccggcccggctaccacacgcagaccgcggggccctggcacctcggcaagctggagatggacttcgacctgtgcgaggggaccaccgtggtggtcacggaggactgcggcaaccgcggcccctccctccggaccaccaccgccagcgggaagctgatcacggagtggtgctgccgcagctgcaccctgccgcccctccggtaccgcggcgaggacgggtgctggtacggcatggagatccggcccctgaaggagaaggaggagaacctggtgaactccctcgtgaccgccgggcacggccagatcgacaacttcagcctgggcgtcctggggatggccctcttcctggaggagatgctgcgcacccggatcggcacgaagcacgcgatcctcctggtggccgtgtccttcgtcaccctgatcaccgggaacatgagcttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgacctccaaggagctgatgatggccacgatcggcatcgccctcctgagccagtccaccatcccggagaccatcctggagctcaccgacgcgctggccctggggatgatggtcctcaagatcgtgcggaacatggagaagtaccagctggccgtgacgatcatggccatcagctgcgtccccaacgccgtgatcctgcagaacgcgtggaaggtgtcctgcaccatcctcgccgccgtcagcgtgagccccctgctgctcaccagctcccagcagaaggccgactggatccccctggcgctgaccatcaagggcctcaacccgacggccatcttcctgaccaccctgagccgcacctccaagaagcggagctggcccctcaacgaggccatcatggccgtcggcatggtgtccatcctggccagctccctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatcagcgggtccagcccgatcctgtccatcaccatcagcgaggacggctccatgagcatcaagaacgaggaggaggagcagacgctgaccatcctcatccgcaccggcctgctggtcatctccggggtgttccccgtgagcatccccatcaccgcggccgcctggtacctctgggaggtcaagaagcagcgggccggcgtgctgtgggacgtgccctccccgccgcccgtcgagaaggccgagctggaggacggggcgtaccgcatcaagcagcggggcatcctcgggtacagccagatcggcgccggcgtgtacaaggaggggaccttccacacgatgtggcacgtgacccgcggcgccgtcctgatgcaccgggggaagcgcatcgagccgtcctgggccgacgtgaagaaggacctgatcagctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgtccctcgacttcagcccgggcacctccggcagccccatcgtcgaccgcaaggggaaggtggtgggcctgtacgggaacggcgtcgtgacccggtccggcgcctacgtgagcgccatcgcgcagacggagaagtccatcgaggacaaccccgagatcgaggacgacatcttccgcaagaagcggctgaccatcatggacctccaccccggggccggcaagaccaagcgctacctgccggccatcgtccgggaggccatcaagcgcgggctgcgcaccctgatcctcgcccccacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgccgaactacaacctcatcatcatggacgaggcgcacttcaccgaccccgccagcatcgccgcccggggctacatctccacgcgcgtcgagatgggcgaggccgcggggatcttcatgaccgccacgccgcccggcagccgggacccgttcccccagtccaacgcccccatcatggacgaggagcgcgagatccccgagcggagctggaactccgggcacgagtgggtgaccgacttcaagggcaagacggtgtggttcgtcccgagcatcaaggccgggaacgacatcgcggcctgcctgcgcaagaacggcaagaaggtgatccagctgtcccggaagaccttcgacagcgagtacgtgaagacccgcgccaacgactgggacttcgtcgtgaccacggacatctccgagatgggcgccaacttcaaggccgagcgggtgatcgacccccgccggtgcatgaagcccgtcatcctcaccgacggggaggagcgcgtgatcctggcgggccccatgccggtgacccacagctccgccgcccagcggcgcgggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcaccgagatgggccggctgcccacgttcatgacccagaaggcccgcaacgccctcgacaacctggccgtgctgcacaccgccgaggccgggggccgggcctacaaccacgccctctccgagctgcccgagaccctggagacgctcctgctgctcaccctgctggccaccgtcaccgggggcatcttcctcttcctgatgagcggcaaggggatcggcaagatgaccctggggatgtgctgcatcatcacggcctccatcctcctgtggtacgcgcagatccagccgcactggatcgccgccagcatcatcctggagttcttcctcatcgtgctgctgatccccgagcccgagaagcagcgcacgccccaggacaaccagctcacctacgtcgtgatcgccatcctgaccgtggtcgccgcgacgatggccaacgagatgggcttcctggagaagaccaagaaggacctcgggctgggctccatcaccacccaggagagcgagagcaacatcctggacatcgacctccggccggcctccgcctggacgctgtacgccgtggcgaccaccttcgtgacccccatgctgcgccacagcatcgagaactccagcgtcaacgtgtccctcacggccatcgccaaccaggccaccgtgctgatgggcctggggaagggctggcccctcagcaagatggacatcggggtccccctgctggcgatcggctgctactcccaggtgaacccgatcaccctcaccgccgccctgctgctcctggtggcccactacgccatcatcgggcccggcctgcaggcgaaggccacgcgggaggcccagaagcgcgccgccgcgggcatcatgaagaaccccaccgtcgacgggatcaccgtgatcgacctcgagcccatcccgtacgaccccaagttcgagaagcagctgggccaggtgatgctgctcatcctgtgcgtcacccaggtgctgatgatgcggacgacctgggccctctgcgaggccctgaccctggccaccgggcccatcagcacgctctgggagggcaaccccgggcgcttctggaacaccaccatcgccgtgtccatggcgaacatcttccgcggcagctacctggccggcgccgggctcctgttctccatcatgaagaacaccacgaacacccggcgcggcaccgggaacatcggcgagaccctgggcgagaagtggaagtcccggctgaacgccctcgggaagtccgagttccagatctacaagaagtccggcatccaggaggtcgaccgcacgctggcgaaggaggggatcaagcggggcgagaccgaccaccacgccgtgtcccgcgggagcgccaagctgcggtggttcgtggagcgcaacatggtcaccccggagggcaaggtggtggacctcggctgcgggcggggcgggtggtcctactactgcggcgggctgaagaacgtccgcgaggtgaagggcctgaccaagggcgggcccggccacgaggagcccatccccatgagcacgtacgggtggaacctcgtgcggctgcagtccggcgtcgacgtgttcttcaccccgcccgagaagtgcgacaccctgctctgcgacatcggggagagcagccccaaccccaccatcgaggccggccgcaccctgcgggtgctgaacctcgtcgagaactggctgaacaacaacacgcagttctgcatcaaggtgctgaacccgtacatgccctccgtgatcgagaagatggaggccctccagcgcaagtacggcggggcgctggtccggaaccccctgagccgcaactccacccacgagatgtactgggtgagcaacgccaccggcaacatcgtgtccagcgtcaacatgatctcccggatgctgatcaaccgcttcaccatgaagcacaagaaggccacgtacgagccggacgtggacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccctgggacgtggtcccgatggtgacccagatggcgatgacggacaccacccccttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgctccaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggctcccgcgccatctggtacatgtggctcggggcgcggttcctggagttcgaggccctgggcttcctcaacgaggaccactggttcagccgcgggaactccctgagcggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggccgacgccccgcggcaccgtcatggacatcatcagccggcgcgaccagcgcggctccgggcaggtcggcacctacgggctcaacacgttcaccaacatggaggcccagctgatccggcagatggagggcgagggcatcttcaagagcatccagcacctgaccgccaccgaggagatcgccgtgcagaactggctcgcgcgcgtcgggcgggagcgcctgtcccggatggccatcagcggcgacgactgcgtggtgaagcccatcgacgaccgcttcgcctccgccctgacggccctcaacgacatggggaaggtccggaaggacatccagcagtgggagcccagccgcggctggaacgactggacccaggtgccgttctgctcccaccacttccacgagctggtgatgaaggacgggcgggtcctggtggtgccctgccgcaaccaggacgagctcatcggccgggcgcgcatcagccagggcgccgggtggtccctgaaggagaccgcctgcctgggcaagagctacgcccagatgtggaccctcatgtacttccaccggcgcgacctgcggctggccgcgaacgccatctgctccgccgtccccagccactgggtgcccacctcccgcacgacctggagcatccacgccaagcacgagtggatgaccaccgaggacatgctcgcggtgtggaaccgggtctggatccaggagaacccgtggatggaggacaagacgcccgtggagtcctgggaggaggtgccctacctggggaagcgcgaggaccagtggtgcggcagcctgatcgggctcacctcccgggccacctgggccaagaacatccagaccgccatcaaccaggtccgcagcctgatcggcaacgaggagtacacggactacatgcccagcatgaagcgcttccggcgcgaggaggaggaggccggcgtgctgtggtga

SEQ ID NO: 9246 - RNA, 9876 nt, synthetic construct
  misc_feature 1..9876: note = derived and/or modified CDS sequence (opt1) from DENV-2__FJ906962__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgagatcaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccggccgggctaccacacgcagaccgcggggccctggcacctcggcaagctggagatggacttcgacctgtgcgaggggaccaccgtcgtggtgacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtcaacagcctcgtgaccgccgggcacggccagatcgacaacttctccctgggcgtgctggggatggccctcttcctggaggagatgctgcgcacccggatcggcacgaagcacgcgatcctcctggtcgccgtgagcttcgtgaccctgatcaccgggaacatgtccttccgcgacctcggccgcgtcatggtgatggtgggggccaccatgacggacgacatcggcatgggcgtcacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaacatcctggagctcaccgacgcgctggccctggggatgatggtgctcaagatcgtccggaacatggagaagtaccagctggccgtgaccatcatggccatctcctgcgtgccgaacgccgtcatcctgcagaacgcgtggaaggtgagctgcacgatcctcgccgccgtgtccgtcagccccctgctgctcacctccagccagcagaaggccgactggatccccctggcgctgaccatcaagggcctcaaccccaccgccatcttcctgacgaccctgtcccgcaccagcaagaagcggtcctggccgctcaacgaggccatcatggccgtgggcatggtcagcatcctggcctccagcctgctcaagaacgacatccccatgaccgggcccctggtggcgggcgggctgctcacggtgtgctacgtcctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagaccctgacgatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggagaaggccgagctggaggacggggcgtaccgcatcaagcagcggggcatcctcgggtactcccagatcggcgccggcgtctacaaggaggggaccttccacaccatgtggcacgtgacgcgcggcgccgtgctgatgcaccgggggaagcgcatcgagcccagctgggccgacgtcaagaaggacctgatctcctacggcgggggctggaagctcgagggcgagtggaaggagggggaggaggtccaggtgctggccctggagcccggcaagaacccccgggcggtccagaccaagcccgggatcttcaagaccaacaccggcacgatcggggccgtgagcctcgacttctcccccggcaccagcggctcccccatcgtggaccgcaaggggaaggtcgtgggcctgtacgggaacggcgtggtcacccggagcggcgcctacgtgtccgccatcgcgcagaccgagaagtccatcgaggacaaccccgagatcgaggacgacatcttccgcaagaagcggctgacgatcatggacctccaccccggggccggcaagaccaagcgctacctgcccgccatcgtgcgggaggccatcaagcgcgggctgcgcaccctgatcctcgccccgacccgggtcgtggcggccgagatggaggaggccctgcgcggcctgcccatccggtaccagacgaccgccatcaagaccgagcacaccgggcgcgagatcgtggacctcatgtgccacgccacgttcaccatgcggctgctgagccccgtccgcgtgcccaactacaacctcatcatcatggacgaggcgcacttcaccgacccggcctccatcgccgcccggggctacatcagcacccgcgtggagatgggcgaggccgcggggatcttcatgacggccacgccgcccggctcccgggaccccttcccgcagagcaacgcccccatcatggacgaggagcgcgagatccccgagcggtcctggaacagcgggcacgagtgggtcaccgacttcaagggcaagaccgtgtggttcgtgccctccatcaaggccgggaacgacatcgcggcctgcctgcgcaagaacggcaagaaggtcatccagctgagccggaagacgttcgactccgagtacgtgaagacccgcgccaacgactgggacttcgtggtcaccaccgacatcagcgagatgggcgccaacttcaaggccgagcgggtgatcgacccgcgccggtgcatgaagcccgtgatcctcacggacggggaggagcgcgtcatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtggacgcgatcgacggcgagtaccggctgcgcggggaggcccggaagaccttcgtcgacctcatgcgccggggcgacctgcccgtgtggctggcctacaaggtggccgccgaggggatcaactacgcggaccgcaagtggtgcttcgacggcatcaagaacaaccagatcctcgaggagaacatggaggtcgagatctggacgaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccaccttcatgacgcagaaggcccgcaacgccctcgacaacctggccgtgctgcacaccgccgaggccgggggccgggcctacaaccacgccctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcgcagatccagccccactggatcgccgcctccatcatcctggagttcttcctcatcgtcctgctgatcccggagcccgagaagcagcgcacgccccaggacaaccagctcacctacgtggtcatcgccatcctgaccgtggtggccgcgaccatggccaacgagatgggcttcctggagaagacgaagaaggacctcgggctgggcagcatcaccacccaggagagcgagtccaacatcctggacatcgacctccggcccgccagcgcctggaccctgtacgccgtcgcgacgaccttcgtgaccccgatgctgcgccactccatcgagaacagctccgtgaacgtcagcctcaccgccatcgccaaccaggccacggtgctgatgggcctggggaagggctggcccctctccaagatggacatcggggtgcccctgctggcgatcggctgctacagccaggtcaaccccatcaccctcaccgccgccctgctgctcctggtggcccactacgccatcatcgggccgggcctgcaggcgaaggccacccgggaggcccagaagcgcgccgccgcgggcatcatgaagaaccccacggtggacgggatcaccgtcatcgacctcgagcccatcccctacgacccgaagttcgagaagcagctgggccaggtgatgctgctcatcctgtgcgtgacccaggtcctgatgatgcggaccacgtgggccctctgcgaggccctgaccctggccaccgggcccatctccaccctctgggagggcaaccccgggcgcttctggaacacgaccatcgccgtgagcatggcgaacatcttccgcggctcctacctggccggcgccgggctcctgttcagcatcatgaagaacaccaccaacacgcggcgcggcaccgggaacatcggcgagaccctgggcgagaagtggaagtcccggctgaacgccctcggcaagagcgagttccagatctacaagaagtccggcatccaggaggtggaccgcaccctggcgaaggaggggatcaagcggggcgagacggaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgaccaagggcgggccgggccacgaggagcccatccccatgtccacctacgggtggaacctcgtgcggctgcagagcggcgtggacgtcttcttcacgcccccggagaagtgcgacaccctgctctgcgacatcggggagagctcccccaaccccaccatcgaggccggccgcaccctgcgggtgctgaacctcgtggagaactggctgaacaacaacacccagttctgcatcaaggtcctgaacccctacatgccgagcgtgatcgagaagatggaggccctccagcgcaagtacggcggggcgctggtgcggaaccccctgtcccgcaacagcacgcacgagatgtactgggtctccaacgccaccggcaacatcgtgagctccgtgaacatgatcagccggatgctgatcaaccgcttcaccatgaagcacaagaaggccacctacgagcccgacgtcgacctcgggtccggcacgcggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccgcctgctcaccaagccctgggacgtggtgcccatggtcacccagatggcgatgaccgacacgaccccgttcgggcagcagcgggtgttcaaggagaaggtggacacccgcacccaggagcccaaggagggcacgaagaagctgatgaagatcaccgccgagtggctgtggaaggagctcggcaagaagaagacgccccggatgtgcacccgcgaggagttcacgcggaaggtccgcagcaacgccgccctgggggccatcttcaccgacgagaacaagtggaagtccgcgcgggaggccgtggaggacggccgcttctgggagctggtggaccgggagcgcaacctccacctggaggggaagtgcgagacctgcgtctacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtggggaagaaggagggcggggccatgtacgccgacgacaccgccggctgggacacgcggatcaccctggaggacctcaagaacgaggagatggtcaccaaccacatgaagggggagcacaagaagctggcggaggccatcttcaagctgacctaccagaacaaggtggtccgcgtgcagcggcccacgccgcgcggcaccgtgatggacatcatctcccggcgcgaccagcgcggcagcgggcaggtcggcacctacgggctcaacaccttcacgaacatcgaggcccagctgatccggcagatggagggcgagggcatcttcaagtccatccagcacctgaccgccaccgaggagatcgccgtgcagaactggctcgcgcgcgtggggcgggagcgcctgagccggatggccatctccggcgacgactgcgtcgtgaagcccatcgacgaccgcttcgccagcgccctgaccgccctcaacgacatggggaaggtgcggaaggacatccagcagtgggagccctcccgcggctggaacgactggacgcaggtccccttctgcagccaccacttccacgagctggtgatgaaggacgggcgggtgctggtcgtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtgccctcccactgggtccccaccagccgcaccacgtggtccatccacgccaagcacgagtggatgaccaccgaggacatgctcgcggtgtggaaccgggtgtggatccaggagaacccctggatggaggacaagaccccggtcgagagctgggaggaggtgccctacctggggaagcgcgaggaccagtggtgcggctccctgatcgggctcacgagccgggccacctgggccaagaacatccagaccgccatcaaccaggtgcgcagcctgatcggcaacgaggagtacaccgactacatgccctccatgaagcgcttccggcgcgaggaggaggaggccggcgtcctgtggtga

SEQ ID NO: 9247 - RNA, 9876 nt, synthetic construct
  misc_feature 1..9876: note = derived and/or modified CDS sequence (opt1) from DENV-2__FJ850053__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccaccccggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagccccacaaccagaccttcctgatcgacgggccggagaccgccgagtgccccaacacgaaccgcgcctggaactccctggaggtcgaggactacggcttcggggtgttcaccaccaacatctggctcaagctgcgggagaagcaggacgtgttctgcgacagcaagctgatgtccgccgccatcaaggacaaccgcgcggtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggccggtgagccagcacaactaccggcccggctaccacacgcagaccgcggggccctggcacctcggcaagctggagatggacttcgacctgtgcgaggggaccaccgtggtggtcacggaggactgcggcaaccgcggcccctccctccggaccaccaccgccagcgggaagctgatcacggagtggtgctgccgcagctgcaccctgccgcccctccggtaccgcggcgaggacgggtgctggtacggcatggagatccggcccctgaaggagaaggaggagaacctggtgaactccctcgtgaccgccgggcacggccagatcgacaacttcagcctgggcgtcctggggatggccctcttcctggaggagatgctgcgcacccggatcggcacgaagcacgcgatcctcctggtggccgtgtccttcgtcaccctgatcaccgggaacatgagcttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgacctccaaggagctgatgatggccacgatcggcatcgccctcctgagccagtccaccatcccggagaccatcctggagctcaccgacgcgctggccctggggatgatggtcctcaagatcgtgcggaacatggagaagtaccagctggccgtgacgatcatggccatcagctgcgtccccaacgccgtgatcctgcagaacgcgtggaaggtgtcctgcaccatcctcgccgccgtcagcgtgagccccctgctgctcaccagctcccagcagaaggccgactggatccccctggcgctgaccatcaagggcctcaacccgacggccatcttcctgaccaccctgagccgcacctccaagaagcggagctggcccctcaacgaggccatcatggccgtcggcatggtgtccatcctggccagctccctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatcagcgggtccagcccgatcctgtccatcaccatcagcgaggacggctccatgagcatcaagaacgaggaggaggagcagacgctgaccatcctcatccgcaccggcctgctggtcatctccggggtgttccccgtgagcatccccatcaccgcggccgcctggtacctctgggaggtcaagaagcagcgggccggcgtgctgtgggacgtgccctccccgccgcccgtcgagaaggccgagctggaggacggggcgtaccgcatcaagcagcggggcatcctcgggtacagccagatcggcgccggcgtgtacaaggaggggaccttccacacgatgtggcacgtgacccgcggcgccgtcctgatgcaccgggggaagcgcatcgagccgtcctgggccgacgtgaagaaggacctgatcagctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgtccctcgacttcagcccgggcacctccggcagccccatcgtcgaccgcaaggggaaggtggtgggcctgtacgggaacggcgtcgtgacccggtccggcgcctacgtgagcgccatcgcgcagacggagaagtccatcgaggacaaccccgagatcgaggacgacatcttccgcaagaagcggctgaccatcatggacctccaccccggggccggcaagaccaagcgctacctgccggccatcgtccgggaggccatcaagcgcgggctgcgcaccctgatcctcgcccccacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgccgaactacaacctcatcatcatggacgaggcgcacttcaccgaccccgccagcatcgccgcccggggctacatctccacgcgcgtcgagatgggcgaggccgcggggatcttcatgaccgccacgccgcccggcagccgggacccgttcccccagtccaacgcccccatcatggacgaggagcgcgagatccccgagcggagctggaactccgggcacgagtgggtgaccgacttcaagggcaagacggtgtggttcgtcccgagcatcaaggccgggaacgacatcgcggcctgcctgcgcaagaacggcaagaaggtgatccagctgtcccggaagaccttcgacagcgagtacgtgaagacccgcgccaacgactgggacttcgtcgtgaccacggacatctccgagatgggcgccaacttcaaggccgagcgggtgatcgacccccgccggtgcatgaagcccgtcatcctcaccgacggggaggagcgcgtgatcctggcgggccccatgccggtgacccacagctccgccgcccagcggcgcgggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcaccgagatgggccggctgcccacgttcatgacccagaaggcccgcaacgccctcgacaacctggccgtgctgcacaccgccgaggccgggggccgggcctacaaccacgccctctccgagctgcccgagaccctggagacgctcctgctgctcaccctgctggccaccgtcaccgggggcatcttcctcttcctgatgagcggcaaggggatcggcaagatgaccctggggatgtgctgcatcatcacggcctccatcctcctgtggtacgcgcagatccagccgcactggatcgccgccagcatcatcctggagttcttcctcatcgtgctgctgatccccgagcccgagaagcagcgcacgccccaggacaaccagctcacctacgtcgtgatcgccatcctgaccgtggtcgccgcgacgatggccaacgagatgggcttcctggagaagaccaagaaggacctcgggctgggctccatcaccacccaggagagcgagagcaacatcctggacatcgacctccggccggcctccgcctggacgctgtacgccgtggcgaccaccttcgtgacccccatgctgcgccacagcatcgagaactccagcgtcaacgtgtccctcacggccatcgccaaccaggccaccgtgctgatgggcctggggaagggctggcccctcagcaagatggacatcggggtccccctgctggcgatcggctgctactcccaggtgaacccgatcaccctcaccgccgccctgctgctcctggtggcccactacgccatcatcgggcccggcctgcaggcgaaggccacgcgggaggcccagaagcgcgccgccgcgggcatcatgaagaaccccaccgtcgacgggatcaccgtgatcgacctcgagcccatcccgtacgaccccaagttcgagaagcagctgggccaggtgatgctgctcatcctgtgcgtcacccaggtgctgatgatgcggacgacctgggccctctgcgaggccctgaccctggccaccgggcccatcagcacgctctgggagggcaaccccgggcgcttctggaacaccaccatcgccgtgtccatggcgaacatcttccgcggcagctacctggccggcgccgggctcctgttctccatcatgaagaacaccacgaacacccggcgcggcaccgggaacatcggcgagaccctgggcgagaagtggaagtcccggctgaacgccctcgggaagtccgagttccagatctacaagaagtccggcatccaggaggtcgaccgcacgctggcgaaggaggggatcaagcggggcgagaccgaccaccacgccgtgtcccgcgggagcgccaagctgcggtggttcgtggagcgcaacatggtcaccccggagggcaaggtggtggacctcggctgcgggcggggcgggtggtcctactactgcggcgggctgaagaacgtccgcgaggtgaagggcctgaccaagggcgggcccggccacgaggagcccatccccatgagcacgtacgggtggaacctcgtgcggctgcagtccggcgtcgacgtgttcttcaccccgcccgagaagtgcgacaccctgctctgcgacatcggggagagcagccccaaccccaccatcgaggccggccgcaccctgcgggtgctgaacctcgtcgagaactggctgaacaacaacacgcagttctgcatcaaggtgctgaacccgtacatgccctccgtgatcgagaagatggaggccctccagcgcaagtacggcggggcgctggtccggaaccccctgagccgcaactccacccacgagatgtactgggtgagcaacgccaccggcaacatcgtgtccagcgtcaacatgatctcccggatgctgatcaaccgcttcaccatgaagcacaagaaggccacgtacgagccggacgtggacctcgggagcggcacccggaacatcgggatcgagtccgagatccccaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccctgggacgtggtcccgatggtgacccagatggcgatgacggacaccacccccttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgctccaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggctcccgcgccatctggtacatgtggctcggggcgcggttcctggagttcgaggccctgggcttcctcaacgaggaccactggttcagccgcgggaactccctgagcggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggccgacgccccgcggcaccgtcatggacatcatcagccggcgcgaccagcgcggctccgggcaggtcggcacctacgggctcaacacgttcaccaacatggaggcccagctgatccggcagatggagggcgagggcatcttcaagagcatccagcacctgaccgccaccgaggagatcgccgtgcagaactggctcgcgcgcgtcgggcgggagcgcctgtcccggatggccatcagcggcgacgactgcgtggtgaagcccatcgacgaccgcttcgcctccgccctgacggccctcaacgacatggggaaggtccggaaggacatccagcagtgggagcccagccgcggctggaacgactggacccaggtgccgttctgctcccaccacttccacgagctggtgatgaaggacgggcgggtcctggtggtgccctgccgcaaccaggacgagctcatcggccgggcgcgcatcagccagggcgccgggtggtccctgaaggagaccgcctgcctgggcaagagctacgcccagatgtggaccctcatgtacttccaccggcgcgacctgcggctggccgcgaacgccatctgctccgccgtccccagccactgggtgcccacctcccgcacgacctggagcatccacgccaagcacgagtggatgaccaccgaggacatgctcgcggtgtggaaccgggtctggatccaggagaacccgtggatggaggacaagacgcccgtggagtcctgggaggaggtgccctacctggggaagcgcgaggaccagtggtgcggcagcctgatcgggctcacctcccgggccacctgggccaagaacatccagaccgccatcaaccaggtccgcagcctgatcggcaacgaggagtacacggactacatgcccagcatgaagcgcttccggcgcgaggaggaggaggccggcgtgctgtggtga

SEQ ID NO: 9248 - RNA, 9876 nt, synthetic construct
  misc_feature 1..9876: note = derived and/or modified CDS sequence (opt1) from DENV-2__JN819420__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagcgcgccagcttcatcgaggtgaagtcctgccactggcccaagagccacaccctgtggtccaacggcgtcctggagagcgagatgatcatccccaagaacttcgccgggcccgtgtcccagcacaactaccggccgggctaccacacgcagaccgcggggccctggcacctcggcaagctggagatggacttcgacttctgcgaggggaccaccgtggtcgtgacggaggactgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtgaacagcctggtcaccgccgggcacggccagatcgacaacttctccctcggcgtgctggggatggccctgttcctcgaggagatgctgcgcacccggatcggcacgaagcacgcgatcctgctcgtggccgtcagcttcgtgaccctgatcaccgggaacatgtccttccgcgacctgggccgcgtgatggtcatggtgggggccaccatgacggacgacatcggcatgggcgtgacctacctcgccctgctggccgcgttcaaggtccggcccaccttcgccgccgggctcctgctgcgcaagctcaccagcaaggagctgatgatggccacgatcggcatcgccctgctctcccagagcaccatccccgagaccatcctggagctgaccgacgcgctcgccctggggatgatggtgctgaagatcgtgcggaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccgcaccagcaagaagcggtcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccgcagcgccgacctggagctggagcgggccgccgacgtcaagtgggaggaccaggccgagatctccgggagctcccccatcctcagcatcaccatctccgaggacggcagcatgtccatcaagaacgaggaggaggagcagacgctgaccatcctgatccgcaccggcctcctggtgatcagcggggtgttcccggtctccatccccatcaccgcggccgcctggtacctgtgggaggtgaagaagcagcgggccggcgtgctctgggacgtccccagcccgccgcccgtggagaaggccgagctggaggacggggcgtaccgcatcaagcagcggggcatcctggggtactcccagatcggcgccggcgtgtacaaggaggggaccttccacacgatgtggcacgtcacccgcggcgccgtgctcatgcaccgggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagaccaagcccgggatcttcaagaccaacacgggcaccatcggggccgtcagcctggacttctcccccggcaccagcggctcccccatcgtggaccgcaaggggaaggtggtcggcctctacgggaacggcgtggtgacccggagcggcgcctacgtctccgccatcgcgcagacggagaagtccatcgaggacaaccccgagatcgaggacgacatcttccgcaagaagcggctgaccatcatggacctgcaccccggggccggcaagaccaagcgctacctccccgccatcgtgcgggaggccatcaagcgcgggctgcgcaccctgatcctggccccgacgcgggtggtcgcggccgagatggaggaggccctccgcggcctgcccatccggtaccagacccccgccatcaagaccgagcacaccgggcgcgagatcgtggacctgatgtgccacgccacgttcaccatgcggctcctgagccccgtgcgcgtcccgaactacaacctgatcatcatggacgaggcgcacttcaccgaccccgcctccatcgccgcccggggctacatcagcacccgcgtggagatgggcgaggccgcggggatcttcatgacggccacgccgcccggctcccgggacccgttcccccagagcaacgcccccatcatggacgaggagcgcgagatccccgagcggtcctggaacagcgggcacgagtgggtgaccgacttcaagggcaagaccgtctggttcgtgccgtccatcaaggccgggaacgacatcgcggcctgcctccgcaagaacggcaagaaggtgatccagctgagccggaagacgttcgactccgagtacgtcaagacccgcgccaacgactgggacttcgtggtgaccaccgacatcagcgagatgggcgccaacttcaaggccgagcgggtcatcgacccccgccggtgcatgaagcccgtgatcctgacggactccgaggagcgcgtgatcctcgcggggcccatgccggtcacccacagctccgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgaggggatcatcccgagcatgttcgagcccgagcgcgagaaggtggacgcgatcgacggcgagtaccggctgcgcggcgaggcccggaagaccttcgtggacctgatgcgccgcggggacctccccgtctggctggcctacaaggtggccgccgagggcatcaactacgcggaccgcaagtggtgcttcgacgggatcaagaacaaccagatcctggaggagaacatggaggtggagatctggacgaaggagggcgagcggaagaagctcaagccgcgctggctggacgcccggatctactccgaccccctggccctcaaggagttcaaggagttcgccgcggggcgcaagagcctgaccctgaacctcatcaccgagatgggccggctgcccaccttcatgacgcagaaggcccgcaacgccctggacaacctcgccgtcctgcacaccgccgaggcgggcgggcgggcctacaaccacgccctgtccgagctccccgagaccctggagaccctgctcctgctgacgctcctggccaccgtgaccggcgggatcttcctgttcctcatgagcggcaagggcatcgggaagatgaccctgggcatgtgctgcatcatcaccgcctccatcctgctctggtacgcgcagatccagccgcactggatcgccgccagcatcatcctggagttcttcctgatcgtcctcctgatccccgagcccgagaagcagcgcacgccccaggacaaccagctgacctacgtggtgatcgccatcctcaccgtcgtggccgcgaccatggccaacgagatggggttcctggagaagacgaagaaggacctgggcctcgggagcatcaccacccaggagtccgagagcaacatcctggacatcgacctgcggccggcctccgcctggaccctctacgccgtggcgacgaccttcgtcacccccatgctgcgccacagcatcgagaactccagcgtgaacgtgtccctgaccgccatcgccaaccaggccacggtcctcatgggcctgggcaaggggtggcccctgagcaagatggacatcggcgtgcccctcctggcgatggggtgctactcccagttcaagccgatcaccctgaccgccgccctcctgctgctcgtggcccactacgccatcatcggccccgggctgcaggcgaaggccacccgggaggcccagaagcgcgccgccgcgggcatcatgaagaaccccacggtcgacggcatcaccgtgatcgacctggagcccatcccgtacgaccccaagttcgagaagcagctcgggcaggtcatgctgctgatcctctgcgtcacccaggtgctgatgatgcggaccacgtgggccctgtgcgaggccctcaccctggccaccggccccatcagcaccctgtgggaggggaaccccggccgcttctggaacacgaccatcgccgtgtccatggcgaacatcttccgcgggagctacctcgccggcgccggcctgctgttctccatcatgaagaacaccaccagcacgcggcgcgggaccggcaacatcggggagaccctcggcgagaagtggaagtcccggctgaacgccctgggcaagagcgagttccagatctacaagaagtccgggatccaggaggtcgaccgcaccctcgcgaaggagggcatcaagcgcggggagacggaccaccacgccgtgagccgcggctccgccaagctgcggtggttcgtggagcgcaacatggtcaccccggaggggaaggtggtggacctgggctgcggccgcgggggctggagctactactgcgggggcctcaagaacgtccgcgaggtgaaggggctgaccaagggcggccccgggcacgaggagcccatccccatgagcacctacggctggaacctggtgcggctccagtccggggtcgacgtgttcttcacgccgcccgagaagtgcgacaccctgctgtgcgacatcggcgagagctcccccaaccccaccatcgaggccgggcgcaccctccgggtgctgaacctggtcgagaactggctcaacaacaacacccagttctgcatcaaggtgctgaacccgtacatgcccagcgtgatcgagaagatggaggccctgcagcgccagtacggcggcgcgctcgtccggaaccccctgtcccgcaacagcacgcacgagatgtactgggtgtccaacgccaccgggaacatcgtgagctccgtcaacatgatcagccggatgctgatcaaccgcttcaccatgaagcacaagaaggccacctacgagccggacgtggacctgggctccgggacgcggaacatcggcatcgagagcgagatccccaacctcgacatcatcgggaagcgcatcgagaagatcaagcaggagcacgagatctcctggcactacgaccaggaccacccctacaagacctgggcctaccacggcagctacgagaccaagcagaccggctccgccagctccatggtgaacggggtcgtgcgcctgctgacgaagccctgggacgtggtcccgatggtgacccagatggcgatgaccgacaccacgcccttcggccagcagcgggtgttcaaggagaaggtcgacacccgcacccaggagcccaaggaggggaccaagaagctcatgaagatcacggccgagtggctgtggaaggagctgggcaagaagaagacgccccggatgtgcacccgcgaggagttcaccaagaaggtgcggagcaacgccgccctcggcgccatcttcacggacgagaacaagtggaagtccgcgcgcgaggccgtggaggacgggcggttctgggagctggtcgaccgcgagcggaacctgcacctcgagggcaagtgcgagacctgcgtgtacaacatgatggggaagcgcgagaagaagctgggcgagttcgggaaggccaagggcagccgggccatctggtacatgtggctgggcgcgcgcttcctcgagttcgaggccctggggttcctgaacgaggaccactggttcagccggggcaactccctcagcggggtggagggcgaggggctgcaccgcctgggctacatcctccgggacgtcggcaagaaggagggcggcgccatgtacgccgacgacaccgccgggtgggacacccgcatcacgctggaggacctgaagaacgaggagatggtgaccaaccacatgaagggcgagcacaagaagctcgcggaggccatcttcaagctgacctaccagaacaaggtcgtgcgggtgcagcgcccgacgccccgggggacggtcatggacatcatctcccgccgggaccagcgcggcagcggccaggtggggacctacggcctgaacaccttcaccaacatggaggcccagctcatccgccagatggagggggagggcatcttcaagtccatccagcacctgacggccaccgaggagatcgccgtgcagaactggctggcgcgggtcggccgcgagcggctcagccgcatggccatctccggggacgactgcgtggtgaagcccatcgacgaccggttcgccagcgccctgaccgccctgaacgacatgggcaaggtccgcaaggacatccagcagtgggagccctcccgggggtggaacgactggacccaggtgccgttctgcagccaccacttccacgagctcgtgatgaaggacggccgcgtcctggtggtgccctgccggaaccaggacgagctgatcgggcgcgcgcggatctcccagggcgccggctggagcctcaaggagacggcctgcctggggaagtcctacgcccagatgtggaccctgatgtacttccaccgccgggacctccgcctggccgcgaacgccatctgcagcgccgtcccctcccactgggtgcccaccagccggaccacctggtccatccacgccaagcacgagtggatgacgaccgaggacatgctggcggtgtggaaccgcgtctggatccaggagaacccgtggatggaggacaagacccccgtggagagctgggaggaggtgccctacctcggcaagcgggaggaccagtggtgcgggagcctgatcggcctgacctcccgcgccacgtgggccaagaacatccagaccgccatcaaccaggtccggagcctcatcgggaacgaggagtacaccgactacatgccctccatgaagcgcttccgccgggaggaggaggaggccggcgtgctgtggtga

SEQ ID NO: 9249 - RNA, 9876 nt, synthetic construct
  misc_feature 1..9876: note = derived and/or modified CDS sequence (opt1) from DENV-2__FJ850118__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggtacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagacccccgccatcaagaccgagcacaccgggcgcgagatcgtcgacctcatgtgccacgccacgttcaccatgcggctgctgagccccgtgcgcgtgccgaactacaacctcatcatcatggacgaggcgcacttcaccgaccccgcctccatcgccgcccggggctacatcagcacccgcgtcgagatgggcgaggccgcggggatcttcatgacggccacgccgcccggctcccgggacccgttcccccagagcaacgcccccatcatggacgaggagcgcgagatccccgagcggtcctggaacagcgggcacgagtgggtgaccgacttcaagggcaagaccgtgtggttcgtcccgtccatcaaggccgggaacgacatcgcggcctgcctgcgcaagaacggcaagaaggtgatccagctgagccggaagacgttcgactccgagtacgtgaagacccgcgccaacgactgggacttcgtcgtgaccaccgacatcagcgagatgggcgccaacttcaaggccgagcgggtgatcgacccccgccggtgcatgaagcccgtcatcctcacggacggggaggagcgcgtgatcctggcgggccccatgccggtgacccactccagcgccgcccagcggcgcgggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtcgacgcgatcgacggcgagtaccggctgcgcggggaggcccggaagaccttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggacgaaggagggggagcggaagaagctgaagccgcgctggctggacgcccggatctacagcgaccccctcgccctgaaggagttcaaggagttcgccgcgggccgcaagtccctgaccctcaacctgatcaccgagatgggccggctgcccaccttcatgacgcagaaggcccgcaacgccctcgacaacctggccgtgctgcacaccgccgaggccgggggccgggcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcgcacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccggccggccagcgcctggaccctgtacgccgtggcgacgaccttcgtgacccccatgctgcgccactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacccgggaggcccagaagcgcgccgccgcgggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaaccccgggcgcttctggaacacgaccatcgccgtgagcatggcgaacatcttccgcggctcctacctggccggcgccgggctcctgttcagcatcatgaagaacaccaccaacacgcggcgcggcaccgggaacatcggcgagaccctgggcgagaagtggaagtcccggctgaacgccctcggcaagagcgagttccagatctacaagaagtccggcatccaggaggtcgaccgcaccctggcgaaggaggggatcaagcggggcgagacggaccaccacgccgtgagccgcgggtccgccaagctgcggtggttcgtggagcgcaacatggtcaccccggagggcaaggtggtggacctcggctgcgggcggggcgggtggagctactactgcggcgggctgaagaacgtccgcgaggtgaagggcctgaccaagggcgggcccggccacgaggagcccatccccatgtccacctacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacccagttctgcatcaaggtgctgaacccgtacatgcccagcgtgatcgagaagatggaggccctccagcgcaagtacggcggggcgctggtccggaaccccctgtcccgcaacagcacgcacgagatgtactgggtgtccaacgccaccggcaacatcgtgagctccgtcaacatgatcagccggatgctgatcaaccgcttcaccatgaagcacaagaaggccacctacgagccggacgtggacctcgggtccggcacgcggaacatcgggatcgagagcgagatccccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccctgggacgtggtcccgatggtgacccagatggcgatgaccgacacgacccccttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacaccgccggctgggacacgcggatcaccctggaggacctcaagaacgaggagatggtgaccaaccacatgaagggggagcacaagaagctggcggaggccatcttcaagctgacctaccagaacaaggtcgtgcgcgtgcagcggccgacgccccgcggcaccgtcatggacatcatctcccggcgcgaccagcgcggcagcgggcaggtcggcacctacgggctcaacaccttcacgaacatggaggcccagctgatccggcagatggagggcgagggcatcttcaagtccatccagcacctgaccgccaccgaggagatcgccgtgcagaactggctcgcgcgcgtcgggcgggagcgcctgagccggatggccatctccggcgacgactgcgtggtgaagcccatcgacgaccgcttcgccagcgccctgaccgccctcaacgacatggggaaggtccggaaggacatccagcagtgggagccctcccgcggctggaacgactggacccaggtcccgttctgcagccaccacttccacgagctggtgatgaaggacgggcgggtcctggtggtgccctgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtgccgccccactgggtgccgacctcccgcaccacgtggagcatccacgccaagcacgagtggatgaccaccgaggacatgctcgcggtgtggaaccgggtctggatccaggagaacccctggatggaggacaagacccccgtggagtcctgggaggaggtgccctacctggggaagcgcgaggaccagtggtgcggcagcctgatcgggctcacgtcccgggccacctgggccaagaacatccagaccgccatcaaccaggtccgcagcctgatcggcaacgaggagtacaccgactacatgccgagcatgaagcgcttccggcgcgaggaggaggaggccggcgtgctgtggtga

SEQ ID NO: 9250 - RNA, 9876 nt, synthetic construct
  misc_feature 1..9876: note = derived and/or modified CDS sequence (opt1) from DENV-2__JN819416__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtcctcaagatcgtgcgcaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgccatcgcgcagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcaccctgatcctcgccccgacgcgcgtggtggcggccgagatggaggaggccctgcggggcctgcccatccgctaccagacccccgccatcaagaccgagcacaccgggcgggagatcgtcgacctcatgtgccacgccacgttcaccatgcgcctgctgagccccgtgcgggtgccgaactacaacctcatcatcatggacgaggcgcacttcaccgaccccgcctccatcgccgcccgcggctacatcagcacccgggtcgagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggccgagcgcgtgatcgacccccggcgctgcatgaagcccgtcatcctcacggacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagaccttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtgctgcacaccgccgaggccggcgggcgcgcctacaaccacgccctcagcgagctgcccgagaccctggagaccctcctgctgctcacgctgctggccaccgtcaccggcgggatcttcctcttcctgatgtccgggaaggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccgcccggccagcgcctggaccctgtacgccgtggcgacgaccttcgtgacccccatgctgcggcactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgccgtgagcatggcgaacatcttccgcggctcctacctggccggcgccgggctcctgttcagcatcatgaagaacaccaccaacacgcgccggggcaccgggaacatcggcgagaccctgggcgagaagtggaagtcccgcctgaacgccctcggcaagagcgagttccagatctacaagaagtccggcatccaggaggtcgaccggaccctggcgaaggaggggatcaagcgcggcgagacggaccaccacgccgtgagccgggggtccgccaagctgcgctggttcgtggagcggaacatggtcaccccggagggcaaggtggtggacctcggctgcgggcgcggcgggtggagctactactgcggcgggctgaagaacgtccgggaggtgaagggcctgaccaagggcgggcccggccacgaggagcccatccccatgtccacctacgggtggaacctcgtgcgcctgcagagcggcgtcgacgtgttcttcacgccgcccgagaagtgcgacaccctgctctgcgacatcggggagagctcccccaaccccaccatcgaggccggccggaccctgcgcgtgctgaacctcgtcgagaactggctgaacaacaacacccagttctgcatcaaggtgctgaacccgtacatgcccagcgtgatcgagaagatggaggccctccagcggaagtacggcggggcgctggtccgcaaccccctgtcccggaacagcacgcacgagatgtactgggtgtccaacgccaccggcaacatcgtgagctccgtcaacatgatcagccgcatgctgatcaaccggttcaccatgaagcacaagaaggccacctacgagccggacgtggacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccctgggacgtggtcccgatggtgacccagatggcgatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagacgccccgcatgtgcacccgggaggagttcacgcgcaaggtgcggagcaacgccgccctgggggccatcttcaccgacgagaacaagtggaagtccgcgcgcgaggccgtggaggacagccggttctgggagctggtcgaccgcgagcggaacctccacctggagggcaagtgcgagacctgcgtgtacaacatgatggggaagcgcgagaagaagctgggcgagttcgggaaggccaagggctcccgggccatctggtacatgtggctcggcgcgcgcttcctggagttcgaggccctggggttcctcaacgaggaccactggttcagccggggcaacagcctgtccggggtggagggcgaggggctgcaccgcctcggctacatcctgcgggacgtcggcaagaaggagggcggcgccatgtacgccgacgacaccgccgggtgggacacgcgcatcaccctggaggacctcaagaacgaggagatggtgaccaaccacatgaagggcgagcacaagaagctggcggaggccatcttcaagctgacctaccagaacaaggtcgtgcgggtgcagcgcccgacgccccgggggaccgtcatggacatcatcagccgccgggaccagcgcggctccggccaggtggggacctacggcctcaacaccttcacgaacatggaggcccagctgatccgccagatggagggggagggcatcttcaagagcatccagcacctgaccgccaccgaggagatcgccgtgcagaactggctcgcgcgggtcggccgcgagcggctgtcccgcatggccatcagcggggacgactgcgtggtgaagcccatcgacgaccggttcgcctccgccctgaccgccctcaacgacatgggcaaggtccgcaaggacatccagcagtgggagcccagccgggggtggaacgactggacccaggtcccgttctgctcccaccacttccacgagctggtgatgaaggacggccgcgtcctggtggtgccctgccggaaccaggacgagctcatcgggcgcgcgcggatcagccagggcgccggctggtccctgaaggagaccgcctgcctgggcaagagctacgcccagatgtggaccctcatgtacttccaccgccgggacctgcgcctggccgcgaacgccatctgctccgccgtgccgccccactgggtgccgaccagccggaccacgtggtccatccacgccaagcacgagtggatgaccaccgaggacatgctcgcggtgtggaaccgcgtctggatccaggagaacccctggatggaggacaagacccccgtggagagctgggaggaggtgccctacctgggcaagcgggaggaccagtggtgcgggtccctgatcggcctcacgagccgcgccacctgggccaagaacatccagaccgccatcaaccaggtccggagcctgatcgggaacgaggagtacaccgactacatgccgtccatgaagcgcttccgccgggaggaggaggaggccggcgtgctgtggtga

SEQ ID NO: 9251 - RNA, 9876 nt, synthetic construct
  misc_feature 1..9876: note = derived and/or modified CDS sequence (opt1) from DENV-2__FJ850119__SS-prME
  source 1..9876: mol_type = other RNA
accgcgggcgtgatcgtgatgctgatccccaccgccatggcgttccacctcaccacccgcaacggggagccccacatgatcgtgggccggcaggagaaggggaagtccctgctgttcaagaccgaggacggcatcaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtcttcggcgcgatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacctgtgcgaggggaccaccgtcgtggtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcatcggcacgaagcacgcgatcctcctggtcgccgtgagcttcgtgaccctgatcaccgggaacatgtccttccgggacctcggccgcgtcatggtgatggtgggggccaccatgacggacgacatcggcatgggcgtcacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtgctcaagatcgtccgcaacatggagaagtaccagctggccgtgacgatcatggccatctcctgcgtgccgaacgccgtcatcctgcagaacgcgtggaaggtgagctgcaccatcctcgccgccgtgtccgtcagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtgggcatggtcagcatcctggcctccagcctgctcaagaacgacatccccatgacggggcccctggtggcgggcgggctgctcaccgtgtgctacgtcctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtgatcagcggggtcttcccggtgtccatccccatcaccgcggccgcctggtacctctgggaggtgaagaagcagcgcgccggcgtcctgtgggacgtgcccagcccgccgcccgtggagaaggccgagctggaggacggggcgtaccggatcaagcagcgcggcatcctcgggtactcccagatcggcgccggcgtctacaaggaggggaccttccacacgatgtggcacgtgacccggggcgccgtgctgatgcaccgcgggaagcggatcgagcccagctgggccgacgtcaagaaggacctgatctcctacggcgggggctggaagctcgagggcgagtggaaggagggggaggaggtccaggtgctggccctggagcccggcaagaacccccgcgcggtccagaccaagcccgggatcttcaagaccaacacgggcaccatcggggccgtgagcctcgacttctcccccggcaccagcggctcccccatcgtggaccggaaggggaaggtcgtgggcctgtacgggaacggcgtggtcacccgcagcggcgcctacgtgtccgccatcgcgcagacggagaagtccatcgaggacaaccccgagatcgaggacgacatcttccggaagaagcgcctgaccatcatggacctccaccccggggccggcaagaccaagcggtacctgcccgccatcgtgcgcgaggccatcaagcgggggctgcgcaccctgatcctcgccccgacgcgcgtcgtggcggccgagatggaggaggccctgcggggcctgcccatccgctaccagacccccgccatcaagaccgagcacaccgggcgggagatcgtggacctcatgtgccacgccacgttcaccatgcgcctgctgagccccgtccgggtgccgaactacaacctcatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgcggcctgcctgcggaagaacggcaagaaggtcatccagctgagccgcaagacgttcgactccgagtacgtgaagacccgggccaacgactgggacttcgtggtcaccaccgacatcagcgagatgggcgccaacttcaaggccgagcgcgtgatcgacccccggcgctgcatgaagcccgtgatcctcacggacggggaggagcgggtcatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtggacgcgatcgacggcgagtaccgcctgcgcggggaggcccgcaagaccttcgtcgacctcatgcggcgcggcgacctgcccgtgtggctggcctacaaggtggccgccgaggggatcaactacgcggaccggaagtggtgcttcgacggcatcaagaacaaccagatcctcgaggagaacatggaggtcgagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtgctgcacaccgccgaggccgggggccgcgcctacaaccacgccctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtcatcgccatcctgaccgtggtggccgcgaccatggccaacgagatgggcttcctggagaagacgaagaaggacctcgggctgggcagcatcaccacccaggagagcgagtccaacatcctggacatcgacctccgcccggccagcgcctggaccctgtacgccgtcgcgacgaccttcgtgacccccatgctgcggcactccatcgagaacagctccgtgaacgtcagcctcaccgccatcgccaaccaggccacggtgctgatgggcctggggaagggctggcccctctccaagatggacatcggggtgcccctgctggcgatcggctgctacagccaggtcaacccgatcaccctcaccgccgccctgctgctcctggtggcccactacgccatcatcgggcccggcctgcaggcgaaggccacccgcgaggcccagaagcgggccgccgcgggcatcatgaagaaccccacggtggacgggatcaccgtcatcgacctcgagcccatcccgtacgaccccaagttcgagaagcagctgggccaggtgatgctgctcatcctgtgcgtgacccaggtcctgatgatgcgcaccacgtgggccctctgcgaggccctgaccctggccaccgggcccatctccaccctctgggagggcaaccccgggcggttctggaacacgaccatcgccgtgagcatggcgaacatcttccgcggctcctacctggccggcgccgggctcctgttcagcatcatgaagaacaccaccaacacgcgccggggcaccgggaacatcggcgagaccctgggcgagaagtggaagtcccgcctgaacgccctcggcaagagcgagttccagatctacaagaagtccggcatccaggaggtggaccggaccctggcgaaggaggggatcaagcgcggcgagacggaccaccacgccgtcagccgggggtccgccaagctgcgctggttcgtggagcggaacatggtgaccccggagggcaaggtcgtggacctcggctgcgggcgcggcgggtggagctactactgcggcgggctgaagaacgtgcgggaggtcaagggcctgaccaagggcgggcccggccacgaggagcccatccccatgtccacctacgggtggaacctcgtgcgcctgcagagcggcgtggacgtcttcttcacgccgcccgagaagtgcgacaccctgctctgcgacatcggggagagctcccccaaccccaccatcgaggccggccggaccctgcgcgtgctgaacctcgtggagaactggctgaacaacaacacccagttctgcatcaaggtcctgaacccgtacatgcccagcgtgatcgagaagatggaggccctccagcggaagtacggcggggcgctggtgcgcaaccccctgtcccggaacagcacgcacgagatgtactgggtctccaacgccaccggcaacatcgtgagctccgtgaacatgatcagccgcatgctgatcaaccggttcaccatgaagcacaagaaggccacctacgagccggacgtcgacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtggtccgcctgctcaccaagccctgggacgtggtgccgatggtcacccagatggcgatgaccgacacgacccccttcgggcagcagcgcgtgttcaaggagaaggtggacacccggacccaggagcccaaggagggcacgaagaagctgatgaagatcaccgccgagtggctgtggaaggagctcggcaagaagaagacgccccgcatgtgcacccgggaggagttcacgcgcaaggtccggagcaacgccgccctgggggccatcttcaccgacgagaacaagtggaagtccgcgcgcgaggccgtggaggacggccggttctgggagctggtggaccgcgagcggaacctccacctggaggggaagtgcgagacctgcgtctacaacatgatgggcaagcgcgagaagaagctgggggagttcggcaaggccaagggcagccgggccatctggtacatgtggctcggggcgcgcttcctggagttcgaggccctgggcttcctcaacgaggaccactggttctcccgggggaacagcctgagcggcgtggagggggagggcctgcaccgcctcggctacatcctgcgggacgtggggaagaaggagggcggggccatgtacgccgacgacaccgccggctgggacacgcgcatcaccctggaggacctcaagaacgaggagatggtcaccaaccacatgaagggggagcacaagaagctggcggaggccatcttcaagctgacctaccagaacaaggtggtccgggtgcagcgcccgacgccccggggcaccgtgatggacatcatctcccgccgggaccagcgcggcagcgggcaggtcggcacctacgggctcaacaccttcacgaacatggaggcccagctgatccgccagatggagggcgagggcatcttcaagtccatccagcacctgaccgccagcgaggagaccgccgtgcagaactggctcgcgcgggtggggcgcgagcggctgtcccgcatggccatcagcggcgacgactgcgtcgtgaagcccatcgacgaccggttcgcctccgccctgaccgccctcaacgacatggggaaggtgcgcaaggacatccagcagtgggagcccagccggggctggaacgactggacgcaggtcccgttctgctcccaccacttccacgagctggtgatgaaggacgggcgcgtgctggtcgtgccctgccggaaccaggacgagctcatcggccgcgcgcggatcagccagggcgccgggtggtccctgaaggagaccgcctgcctgggcaagagctacgcccagatgtggaccctcatgtacttccaccgccgggacctgcgcctggccgcgaacgccatctgctccgccgtgccgccccactgggtcccgaccagccggaccacgtggtccatccacgccaagcacgagtggatgaccaccgaggacatgctcgcggtgtggaaccgcgtgtggatccaggagaacccctggatggaggacaagacccccgtcgagagctgggaggaggtgccctacctggggaagcgggaggaccagtggtgcggctccctgatcgggctcacgagccgcgccacctgggccaagaacatccagaccgccatcaaccaggtgcggagcctgatcggcaacgaggagtacaccgactacatgccgtccatgaagcgcttccgccgggaggaggaggaggccggcgtcctgtggtga

SEQ ID NO: 9252 - RNA, 9876 nt, synthetic construct
  misc_feature 1..9876: note = derived and/or modified CDS sequence (opt1) from DENV-2__FJ850064__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgccacgaccatgcgcggcgccaagcggatggccatcctgggggacaccgcctgggacttcggcagcctcgggggcgtcttcacctccatcgggaaggcgctccaccaggtgttcggcgccatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggcgatggtccaggccgactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggcgggcaagcggagcctgcgcccgcagcccaccgagctgaagtactcctggaagacgtggggcaaggccaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgcgatcaaggacaaccgggccgtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgcggggcccgtctcccagcacaactaccgcccgggctaccacacgcagaccgccgggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctgttcctggaggagatgctgcggacccgcatcggcacgaagcacgccatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgcggccttcaaggtgcgccccaccttcgccgccgggctgctgctccggaagctgaccagcaaggagctgatgatggccacgatcggcatcgcgctcctgtcccagagcaccatccccgagaccatcctggagctcaccgacgccctggccctggggatgatggtcctcaagatcgtgcgcaacatggagaagtaccagctggccgtgacgatcatggccatctcctgcgtcccgaacgcggtgatcctgcagaacgcctggaaggtgagctgcaccatcctcgccgccgtctccgtgagccccctgctgctcacctccagccagcagaaggcggactggatccccctggccctgaccatcaagggcctcaaccccacggccatcttcctgaccaccctgtcccggaccagcaagaagcgctcctggccgctcaacgaggccatcatggccgtcggcatggtgagcatcctggcgtccagcctgctcaagaacgacatccccatgacggggcccctggtggccggcgggctgctcaccgtctgctacgtgctgaccggccggagcgccgacctggagctcgagcgcgccgccgacgtgaagtgggaggaccaggcggagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgccgccgcctggtacctctgggaggtcaagaagcagcgcgccggcgtgctgtgggacgtgcccagcccgccgcccgtcgagaaggcggagctggaggacggggcctaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggcgctggagcccggcaagaacccccgcgccgtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgcgatcgcccagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcaccctgatcctcgcgccgacgcgcgtggtggccgccgagatggaggaggccctgcggggcctgcccatccgctaccagacccccgccatcaagaccgagcacaccgggcgggagatcgtcgacctcatgtgccacgcgacgttcaccatgcgcctgctgagccccgtgcgggtgccgaactacaacctcatcatcatggacgaggcccacttcaccgaccccgcctccatcgccgcccgcggctacatcagcacccgggtcgagatgggcgaggcggccgggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggcggagcgcgtgatcgacccccggcgctgcatgaagcccgtcatcctcacggacggggaggagcgggtgatcctggccggccccatgccggtgacccactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtcgacgccatcgacggcgagtaccgcctgcgcggggaggcccgcaagaccttcgtggacctcatgcggcgcggcgacctgcccgtgtggctggcctacaaggtcgccgcggaggggatcaactacgccgaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgcggccggccggaagtccctgaccctcaacctgatcaccgagatgggccgcctgcccaccttcatgacgcagaaggcccggaacgccctcgacaacctggccgtgctgcacaccgcggaggccgggggccgcgcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgcggccaccatggccaacgagatgggcttcctggagaagacgaagaaggacctcgggctgggcagcatcaccacccaggagagcgagtccaacatcctggacatcgacctccgcccggccagcgcctggaccctgtacgcggtggccacgaccttcgtgacccccatgctgcggcactccatcgagaacagctccgtcaacgtgagcctcaccgccatcgccaaccaggcgacggtgctgatgggcctggggaagggctggcccctctccaagatggacatcggggtccccctgctggccatcggctgctacagccaggtgaacccgatcaccctcaccgccgccctgctgctcctggtggcccactacgcgatcatcgggcccggcctgcaggccaaggccacccgcgaggcccagaagcgggccgcggccggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgcggtgagcatggccaacatcttccgcggctcctacctggccggcgccgggctcctcttcagcatcatgaagaacaccaccaacacgcgccggggcaccgggaacatcggcgagaccctgggcgagaagtggaagtcccgcctgaacgcgctcggcaagagcgagttccagatctacaagaagtccggcatccaggaggtcgaccggaccctggccaaggaggggatcaagcgcggcgagacggaccaccacgccgtgagccgggggtccgccaagctgcgctggttcgtggagcggaacatggtcaccccggagggcaaggtggtggacctcggctgcgggcgcggcgggtggagctactactgcggcgggctgaagaacgtccgggaggtgaagggcctgaccaagggcgggcccggccacgaggagcccatccccatgtccacctacgggtggaacctcgtgcgcctgcagagcggcgtcgacgtgttcttcacgccgcccgagaagtgcgacaccctgctctgcgacatcggggagagctcccccaaccccaccatcgaggccggccggaccctgcgcgtgctgaacctcgtcgagaactggctgaacaacaacacccagttctgcatcaaggtgctgaacccgtacatgcccagcgtgatcgagaagatggaggcgctccagcggaagtacggcggggccctggtccgcaaccccctgtcccggaacagcacgcacgagatgtactgggtgtccaacgccaccggcaacatcgtgagctccgtcaacatgatcagccgcatgctgatcaaccggttcaccatgaagcacaagaaggccacctacgagccggacgtggacctcgggtccggcacgcgcaacatcgggatcgagagcgaggtgcccaacctggacatcatcggcaagcggatcgagaagatcaagcaggagcacgagacctcctggcactacgaccaggaccacccctacaagacctgggcctaccacggcagctacgagaccaagcagacggggtccgcgagctccatggtcaacggcgtggtgcgcctgctcaccaagccctgggacgtcgtgccgatggtgacccagatggccatgaccgacacgacccccttcgggcagcagcgcgtcttcaaggagaaggtggacacccggacccaggagcccaaggagggcacgaagaagctgatgaagatcaccgccgagtggctgtggaaggagctcggcaagaagaagacgccccgcatgtgcacccgggaggagttcacgcgcaaggtgcggagcaacgccgccctgggggcgatcttcaccgacgagaacaagtggaagtccgcccgcgaggccgtcgaggacggccggttctgggagctggtggaccgcgagcggaacctccacctggaggggaagtgcgagacctgcgtgtacaacatgatgggcaagcgcgagaagaagctgggggagttcggcaaggccaagggcagccgggcgatctggtacatgtggctcggggcccgcttcctggagttcgaggccctgggcttcctcaacgaggaccactggttctcccgggggaacagcctgagcggcgtcgagggggagggcctgcaccgcctcggctacatcctgcgggacgtggggaagaaggagggcggggccatgtacgccgacgacaccgcgggctgggacacgcgcatcaccctggaggacctcaagaacgaggagatggtcaccaaccacatgaagggggagcacaagaagctggccgaggccatcttcaagctgacctaccagaacaaggtggtgcgggtccagcgcccgacgccccggggcaccgtgatggacatcatctcccgccgggaccagcgcggcagcgggcaggtcggcacctacgggctcaacaccttcacgaacatggaggcccagctgatccgccagatggagggcgagggcatcttcaagtccatccagcacctgaccgccaccgaggagatcgcggtccagaactggctcgcccgggtggggcgcgagcggctgagccgcatggccatctccggcgacgactgcgtggtcaagcccatcgacgaccggttcgccagcgccctgaccgcgctcaacgacatggggaaggtgcgcaaggacatccagcagtgggagccctcccggggctggaacgactggacccaggtgccgttctgcagccaccacttccacgagctggtcatgaaggacgggcgcgtgctggtggtcccctgccggaaccaggacgagctcatcggccgcgcccggatctcccagggcgccgggtggagcctgaaggagaccgcctgcctgggcaagtcctacgcccagatgtggaccctcatgtacttccaccgccgggacctgcgcctggcggccaacgccatctgcagcgccgtgccgccccactgggtgccgacctcccggaccacgtggagcatccacgcgaagcacgagtggatgaccaccgaggacatgctcgccgtctggaaccgcgtgtggatccaggagaacccctggatggaggacaagacccccgtggagtcctgggaggaggtcccctacctggggaagcgggaggaccagtggtgcggcagcctgatcgggctcacgtcccgcgccacctgggccaagaacatccagaccgccatcaaccaggtgcggagcctgatcggcaacgaggagtacaccgactacatgccgagcatgaagcgcttccgccgggaggaggaggaggcgggcgtgctgtggtga

SEQ ID NO: 9253 - RNA, 9876 nt, synthetic construct
  misc_feature 1..9876: note = derived and/or modified CDS sequence (opt1) from DENV-2__FJ850065__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccaccatggccaagaacaagcccaccctggacttcgagctgatcaagaccgaggccaagcagcccgccaccctccgcaagtactgcacggaggccaagctgaccaacaccaccacggagtcccggtgccccacccagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacacgatcgtcatcacgccccacagcggggaggagcacgccgtgggcaacgacaccgggaagcacggcaaggagatcaagatcaccccgcagtccagcatcaccgaggccgagctgacggggtacggcaccgtgaccatggagtgcagcccccggaccggcctcgacttcaacgagatggtcctgctgcagatggaggacaaggcctggctcgtgcaccggcagtggttcctggacctgcccctcccctggctgccgggggccgacacgcagggcagcaactggatccagaaggagaccctggtgaccttcaagaacccccacgcgaagaagcaggacgtcgtggtcctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacgcagcacgggaccatcgtgatccgcgtccagtacgagggcgacggctccccctgcaagatccccttcgagatcaccgacctggagaagcggcacgtgctcgggcgcctgatcaccgtgaacccgatcgtcacggagaaggacagccccgtgaacatcgaggcggagccgcccttcggcgactcctacatcatcatcggggtggagccgggccagctgaagctcaactggttcaagaaggggagctccatcggccagatgttcgagaccaccatgcgcggcgccaagcggatggccatcctgggggacaccgcctgggacttcggcagcctcgggggcgtcttcacgtccatcgggaaggccctccaccaggtgttcggcgcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcgtggtgagctggaagaacaaggagctcaagtgcggctccgggatcttcatcaccgacaacgtccacacctggaccgagcagtacaagttccagcccgagagccccagcaagctggcctccgccatccagaaggcccacgaggagggcatctgcgggatccggagcgtgacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacacgctgtggtccaacggcgtgctggagagcgagatgatcatccccaagaacttcgccgggcccgtctcccagcacaactaccgcccgggctaccacacccagaccgcggggccctggcacctcggcaagctggagatggacttcgacctgtgcgaggggaccacggtggtggtcaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacgcgcatcggcaccaagcacgcgatcctcctggtggccgtgagcttcgtcaccctgatcaccgggaacatgtccttccgggacctcggccgcgtgatggtgatggtcggggccacgatgaccgacgacatcggcatgggcgtgacctacctggccctgctcgccgcgttcaaggtgcgccccaccttcgccgccgggctgctgctccggaagctgacgagcaaggagctgatgatggccaccatcggcatcgccctcctgtcccagagcaccatccccgagaccatcctggagctcacggacgcgctggccctggggatgatggtcctcaagatcgtgcgcaacatggagaagtaccagctggccgtgaccatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgacgatcaagggcctcaaccccaccgccatcttcctgaccaccctgtcccggacgagcaagaagcgctcctggccgctcaacgaggccatcatggccgtcggcatggtgagcatcctggcctccagcctgctcaagaacgacatccccatgaccgggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcacgatctccgaggacggcagcatgtccatcaagaacgaggaggaggagcagaccctgaccatcctcatccggaccggcctgctggtcatcagcggggtgttcccggtgtccatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggacgttccacaccatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagacgaacaccggcaccatcggggccgtgagcctcgacttctcccccggcaccagcggctcccccatcgtcgaccggaaggggaaggtggtgggcctgtacgggaacggcgtcgtgacgcgcagcggcgcctacgtgtccgccatcgcgcagaccgagaagtccatcgaggacaaccccgagatcgaggaggacatcttccggaagaagcgcctgaccatcatggacctccaccccggggccggcaagaccaagcggtacctgcccgccatcgtccgcgaggccatcaagcgggggctgcgcacgctgatcctcgccccgacccgcgtggtggcggccgagatggaggaggccctgcggggcctgcccatccgctaccagacccccgccatcaagaccgagcacacggggcgggagatcgtcgacctcatgtgccacgccaccttcaccatgcgcctgctgagccccgtgcgggtgccgaactacaacctcatcatcatggacgaggcgcacttcaccgaccccgcctccatcgccgcccgcggctacatcagcacgcgggtcgagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagacggtgtggttcgtcccgtccatcaaggccgggaacgacatcgcggcctgcctgcggaagaacggcaagaaggtgatccagctgagccgcaagaccttcgactccgagtacgtgaagacccgggccaacgactgggacttcgtcgtgaccacggacatcagcgagatgggcgccaacttcaaggccgagcgcgtgatcgacccccggcgctgcatgaagcccgtcatcctcaccgacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagacgttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggaccaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccacgttcatgacccagaaggcccggaacgccctcgacaacctggccgtgctgcacaccgccgaggccgggggccgcgcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccgcccggccagcgcctggacgctgtacgccgtggcgaccaccttcgtgacccccatgctgcggcactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacgcgcgaggcccagaagcgggccgccgcgggcatcatgaagaaccccaccgtcgacgggatcaccgtgatcgacctcgagcccatcccgtacgaccccaagttcgagaagcagctgggccaggtgatgctgctcatcctgtgcgtcacccaggtgctgatgatgcgcacgacctgggccctctgcgaggccctgaccctggccaccgggcccatctccacgctctgggagggcaaccccgggcggttctggaacaccaccatcgccgtgagcatggcgaacatcttccgcggctcctacctggccggcgccgggctcctgttcagcatcatgaagaacaccacgaacacccgccggggcaccgggaacatcggcgagaccctgggcgagaagtggaagtcccgcctgaacgccctcggcaagagcgagttccagatctacaagaagtccggcatccaggaggtcgaccggacgctggcgaaggaggggatcaagcgcggcgagaccgaccaccacgccgtgagccgggggtccgccaagctgcgctggttcgtggagcggaacatggtcaccccggagggcaaggtggtggacctcggctgcgggcgcggcgggtggagctactactgcggcgggctgaagaacgtccgggaggtgaagggcctgaccaagggcgggcccggccacgaggagcccatccccatgtccacgtacgggtggaacctcgtgcgcctgcagagcggcgtcgacgtgttcttcaccccgcccgagaagtgcgacaccctgctctgcgacatcggggagagctcccccaaccccaccatcgaggccggccggaccctgcgcgtgctgaacctcgtcgagaactggctgaacaacaacacgcagttctgcatcaaggtgctgaacccgtacatgcccagcgtgatcgagaagatggaggccctccagcggaagcacggcggggcgctggtccgcaaccccctgtcccggaacagcacccacgagatgtactgggtgtccaacgccaccggcaacatcgtgagctccgtcaacatgatcagccgcatgctgatcaaccggttcaccatgaagcacaagaaggccacgtacgagccggacgtggacctcgggtccggcacccgcaacatcgggatcgagagcgagatccccaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtcccgatggtgacccagatggcgatgacggacaccacccccttcgggcagcagcgcgtgttcaaggagaaggtcgacacccggacgcaggagcccaaggagggcaccaagaagctgatgaagatcaccgccgagtggctgtggaaggagctcggcaagaagaagacgccccgcatgtgcacgcgggaggagttcacccgcaaggtgcggagcaacgccgccctgggggccatcttcaccgacgagaacaagtggaagtccgcgcgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggccatctggtacatgtggctcggggcgcgcttcctggagttcgaggccctgggcttcctcaacgaggaccactggttctcccgggggaacagcctgagcggcgtggagggggagggcctgcaccgcctcggctacatcctgcgggacgtcgggaagaaggagggcggggccatgtacgccgacgacacggccggctgggacacccgcatcaccctggaggacctcaagaacgaggagatggtgaccaaccacatgaagggggagcacaagaagctggcggaggccatcttcaagctgacgtaccagaacaaggtcgtgcgggtgcagcgcccgacgccccggggcaccgtcatggacatcatctcccgccgggaccagcgcggcagcgggcaggtcggcacctacgggctcaacacgttcaccaacatggaggcccagctgatccgccagatggagggcgagggcatcttcaagtccatccagcacctgaccgccaccgaggagatcgccgtgcagaactggctcgcgcgggtcgggcgcgagcggctgagccgcatggccatctccggcgacgactgcgtggtgaagcccatcgacgaccggttcgccagcgccctgacggccctcaacgacatggggaaggtccgcaaggacatccagcagtgggagccctcccggggctggaacgactggacccaggtgccgttctgcagccaccacttccacgagctggtgatgaaggacgggcgcgtcctggtggtgccctgccggaaccaggacgagctcatcggccgcgcgcggatctcccagggcgccgggtggagcctgaaggagaccgcctgcctgggcaagtcctacgcccagatgtggaccctcatgtacttccaccgccgggacctgcgcctggccgcgaacgccatctgcagcgccgtgccgccccactgggtgccgacctcccggacgacctggagcatccacgccaagcacgagtggatgaccaccgaggacatgctcgcggtgtggaaccgcgtctggatccaggagaacccctggatggaggacaagacgcccgtggagtcctgggaggaggtgccctacctggggaagcgggaggaccagtggtgcggcagcctgatcgggctcacctcccgcgccacctgggccaagaacatccagaccgccatcaaccaggtccggagcctgatcggcaacgaggagtacacggactacatgccgagcatgaagcgcttccgccgggaggaggaggaggccggcgtgctgtggtga

SEQ ID NO: 9254 - RNA, 9876 nt, synthetic construct
  misc_feature 1..9876: note = derived and/or modified CDS sequence (opt1) from DENV-2__FJ873808__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaagatccgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtgctcaagatcgtccgcaacatggagaagtaccagctggccgtgacgatcatggccatctcctgcgtgccgaacgccgtcatcctgcagaacgcgtggaaggtgagctgcgccatcctcgccgccgtgtccgtcagccccctgctgctcacctccagcaagcagaaggcggactggatccccctggccctgaccatcaagggcctcaaccccaccgccatcttcctgacgaccctgtcccggaccagcaagaagcgctcctggccgctcaacgaggccgtgatggccgtcggcatggtgagcatcctggcgtccagcctgctcaagaacgacatccccatgaccgggcccctggtggccggcgggctgctcacggtctgctacgtgctgaccggccggagcgccgacctggagctcgagcgcgccgccgacgtgaagtgggaggaccaggcggagatctccgggagctcccccatcctgagcatcaccatctccgaggacggcagcatgtccatcaagaacgaggaggaggagcagaccctgacgatcctcatccggaccggcctgctggtcatcagcggggtgttcccggtgtccatccccatcaccgccgccgcctggtacctctgggaggtcaagaagcagcgcgccggcgtgctgtgggacgtgcccagcccgccgcccgtcgagaaggcggagctggaggacggggcctaccggatcaagcagcgcggcatcctcgggtactcccagatcggcgccggcgtgtacaaggaggggaccttccacaccatgtggcacgtgacgcggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggcgctggagcccggcaagaacccccgcgccgtgcagaccaagcccgggatcttcaagaccaacaccggcacgatcggggccgtgagcctcgacttctcccccggcaccagcggctcccccatcgtcgaccggaaggggaaggtggtgggcctgtacgggaacggcgtcgtgacccgcagcggcgcctacgtgtccgcgatcgcccagaccgagaagtccatcgaggacaaccccgagatcgaggacgacatcttccggaagaagcgcctgacgatcatggacctccaccccggggccggcaagaccaagcggtacctgcccgccatcgtccgcgaggccatcaagcgggggctgcgcaccctgatcctcgcgccgacccgcgtggtggccgccgagatggaggaggccctgcggggcctgcccatccgctaccagacgcccgccatcaagaccgagcacaccgggcgggagatcgtcgacctcatgtgccacgcgaccttcacgatgcgcctgctgagccccgtgcgggtgccgaactacaacctcatcatcatggacgaggcccacttcaccgaccccgcctccatcgccgcccgcggctacatcagcacccgggtcgagatgggcgaggcggccgggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctgcggaagaacggcaagaaggtgatccagctgagccgcaagaccttcgactccgagtacgtgaagacgcgggccaacgactgggacttcgtcgtgaccaccgacatcagcgagatgggcgccaacttcaaggcggagcgcgtgatcgacccccggcgctgcatgaagcccgtcatcctcaccgacggggaggagcgggtgatcctggccggccccatgccggtgacgcactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtcgacgccatcgacggcgagtaccgcctgcgcggggaggcccgcaagaccttcgtggacctcatgcggcgcggcgacctgcccgtgtggctggcctacaaggtcgccgcggaggggatcaactacgccgaccggaagtggtgcttcgacggcatccgcaacaaccagatcctcgaggagaacatggaggtggagatctggaccaaggagggggagcggaagaagctgaagccgcgctggctggacgcccggatctacagcgaccccctcgccctgaaggagttcaaggagttcgcggccggccgcaagtccctgacgctcaacctgatcaccgagatgggcaagctgcccaccttcatgacccagaaggcccggaacgccctcgacaacctggccgtgctgcacacggcggaggccgggggccgcgcctacaaccacgccctcagcgagctgcccgagaccctggagaccctcctgctgctcaccctgctggccacggtcaccgggggcatcttcctcttcctgatgtccggcaaggggatcggcaagatgaccctggggatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacgtacgtcgtgatcgccatcctgaccgtggtcgcggccaccatggccaacgagatgggcttcctggagaagaccaagaaggacctcgggctgggcagcatcacgacccaggagagcgagtccaacatcctggacatcgacctccgcccggccagcgcctggaccctgtacgcggtggccaccacgttcgtgacccccatgctgcggcactccatcgagaacagctccgtcaacgtgagcctcaccgccatcgccaaccaggcgaccgtgctgatgggcctggggaagggctggcccctctccaagatggacatcggggtccccctgctggccatcggctgctacagccaggtgaacccgatcacgctcaccgccgccctgctgctcctggtggcccactacgcgatcatcgggcccggcctgcaggccaaggccacccgcgaggcccagaagcgggccgcggccggcatcatgaagaaccccaccgtcgacgggatcacggtgatcgacctcgagcccatcccgtacgaccccaagttcgagaagcagctgggccaggtgatgctgctcatcctgtgcgtcacccaggtgctgatgatgcgcaccacctgggccctctgcgaggccctgacgctggccaccgggcccatctccaccctctgggagggcaaccccgggcggttctggaacaccacgatcgcggtgagcatggccaacatcttccgcggctcctacctggccggcgccgggctcctgttcagcatcatgaagaacaccaccaacacccgccggggcacggggaacatcggcgagaccctgggcgagaagtggaagtcccgcctgaacgcgctcggcaagagcgagttccagatctacaagaagtccggcatccaggaggtcgaccggaccctggccaaggaggggatcaagcgcggcgagaccgaccaccacgccgtgagccgggggtccgccaagctgcgctggttcgtggagcggaacatggtcacgccggagggcaaggtggtggacctcggctgcgggcgcggcgggtggagctactactgcggcgggctgaagaacgtccgggaggtgaagggcctgaccaagggcgggcccggccacgaggagcccatccccatgtccacctacgggtggaacctcgtgcgcctgcagagcggcgtcgacgtgttcttcaccccgcccgagaagtgcgacacgctgctctgcgacatcggggagagctcccccaaccccaccatcgaggccggccggaccctgcgcgtgctgaacctcgtcgagaactggctgaacaacaacacccagttctgcatcaaggtgctgaacccgtacatgcccagcgtgatcgagaagatggaggcgctccagcggaagtacggcggggccctggtccgcaaccccctgtcccggaacagcacccacgagatgtactgggtgtccaacgccacgggcaacatcgtgagctccgtcaacatgatcagccgcatgctgatcaaccggttcaccatgaagcacaagaaggccacctacgagccggacgtggacctcgggtccggcacccgcaacatcgggatcgagagcgagatccccaacctggacatcatcggcaagcggatcgagaagatcaagcaggagcacgagacgtcctggcactacgaccaggaccacccctacaagacctgggcctaccacggcagctacgagaccaagcagaccgggtccgcgagctccatggtgaacggcgtcgtgcgcctgctcacgaagccctgggacgtggtcccgatggtgacccagatggccatgaccgacaccacgcccttcgggcagcagcgcgtgttcaaggagaaggtcgacacccggacccaggagcccaaggagggcaccaagaagctgatgaagatcacggccgagtggctgtggaaggagctcggcaagaagaagacgccccgcatgtgcacccgggaggagttcacccgcaaggtgcggagcaacgccgccctgggggcgatcttcacggacgagaacaagtggaagtccgcccgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggcgatctggtacatgtggctcggggcccgcttcctggagttcgaggccctgggcttcctcaacgaggaccactggttctcccgggggaacagcctgagcggcgtggagggggagggcctgcaccgcctcggctacatcctgcgggacgtcgggaagaaggagggcggggccatgtacgccgacgacaccgcgggctgggacacccgcatcacgctggaggacctcaagaacgaggagatggtgaccaaccacatgaagggggagcacaagaagctggccgaggccatcttcaagctgacctaccagaacaaggtcgtgcgggtgcagcgcccgacgccccggggcacggtcatggacatcatctcccgccgggaccagcgcggcagcgggcaggtcggcacctacgggctcaacaccttcaccaacatggaggcccagctgatccgccagatggagggcgagggcatcttcaagtccatccagcacctgacggccaccgaggagatcgcggtgcagaactggctcgcccgggtcgggcgcgagcggctgagccgcatggccatctccggcgacgactgcgtggtgaagcccatcgacgaccggttcgccagcgccctgaccgcgctcaacgacatggggaaggtccgcaaggacatccagcagtgggagccctcccggggctggaacgactggacccaggtgccgttctgcagccaccacttccacgagctggtgatgaaggacgggcgcgtcctggtggtgccctgccggaaccaggacgagctcatcggccgcgcccggatctcccagggcgccgggtggagcctgaaggagacggcctgcctgggcaagtcctacgcccagatgtggaccctcatgtacttccaccgccgggacctgcgcctggcggccaacgccatctgcagcgccgtgccgccccactgggtgccgacctcccggaccacctggagcatccacgcgaagcacgagtggatgacgaccgaggacatgctcgccgtgtggaaccgcgtctggatccaggggaacccctggatggaggacaagacccccgtggagtcctgggaggaggtgccctacctgggcaagcgggaggaccagtggtgcgggagcctgatcggcctcacctcccgcgccacgtgggccaagaacatccagaccgccatcaaccaggtccggagcctgatcggcaacgaggagtacaccgactacatgccgagcatgaagcgcttccgccgggaggaggaggaggcgggggtgctgtggtga

SEQ ID NO: 9255 - RNA, 9876 nt, synthetic construct
  misc_feature 1..9876: note = derived and/or modified CDS sequence (opt1) from DENV-2__FJ850120__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcgtgaccgaggccgagctgaccgggtacggcacggtcaccatggagtgcagcccccgcaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcaccgacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagacgaccatgcgcggcgccaagcggatggccatcctgggggacaccgcctgggacttcggcagcctcggcggggtgttcacctccatcgggaaggccctccaccaggtgttcggggcgatctacggcgccgccttcagcggggtctcctggacgatgaagatcctgatcggcgtgatcatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtgttcaccaccaacatctggctcaagctgcgggagaagcaggacgtcttctgcgactccaagctgatgagcgccgccatcaaggacaaccgcgcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccggccgggctaccacacgcagaccgcggggccctggcacctcggcaagctggagatggacttcgacctgtgcgaggggaccaccgtggtcgtgacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtcaccgccgggcacggccagatcgacaacttctccctgggcgtgctggggatggccctcttcctggaggagatgctgcgcacccggatcggcacgaagcacgcgatcctcctggtggccgtcagcttcgtgaccctgatcaccgggaacatgtccttccgcgacctcggccgcgtgatggtcatggtgggggccaccatgacggacgacatcggcatgggcgtgacctacctggccctgctcgccgcgttcaaggtccggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtgctcaagatcgtgcggaacatggagaagtaccagctggccgtcacgatcatggccatctcctgcgtgccgaacgccgtgatcctgcagaacgcgtggaaggtcagctgcaccatcctcgccgccgtgtccgtcagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtgggcatggtgagcatcctggcctccagcctgctcaagaacgacatccccatgacggggcccctggtcgcgggcgggctgctcaccgtgtgctacgtgctgaccggccgcagcgccgacctggagctcgagcgggccgccgacgtcaagtgggaggaccaggccgagatctccgggagctcccccatcctgagcatcaccatctccgaggacggcagcatgtccatcaagaacgaggaggaggagcagacgctgaccatcctcatccgcaccggcctgctggtgatcagcggggtgttcccggtctccatccccatcaccgcggccgcctggtacctctgggaggtgaagaagcagcgggccggcgtgctgtgggacgtccccagcccgccgcccgtggagaaggccaagctggaggacggggcgtaccgcatcaagcagcggggcatcctcgggtactcccagatcggcgccggcgtgtacaaggaggggaccttccacacgatgtggcacgtcacccgcggcgccgtgctgatgcaccgggggaagcgcatcgagcccagctgggccgacgtgaagaaggacctgatctcctacggcgggggctggaagctcgagggcgagtggaaggagggggaggaggtccaggtgctggccctggagcccggcaagaacccccgggcggtgcagaccaagcccgggatcttcaagaccaacacgggcaccatcggggccgtcagcctcgacttctcccccggcaccagcggctcccccatcgtggaccgcaaggggaaggtggtcggcctgtacgggaacggcgtggtgacccggagcggcgcctacgtctccgccatcgcgcagacggagaagaacatcgaggacaaccccgagatcgaggacgacatcttccgcaagaagcggctgaccatcatggacctccaccccggggccggcaagaccaagcgctacctgcccgccatcgtgcgggaggccatcaagcgcgggctgcgcaccctgatcctcgccccgacgcgggtggtcgcggccgagatggaggaggccctgcgcggcctgcccatccggtaccagacccccgccatcaagaccgagcacaccgggcgcgagatcgtggacctcatgtgccacgccacgttcaccatgcggctgctgagccccgtgcgcgtcccgaactacaacctcatcatcatggacgaggcgcacttcaccgaccccgccagcatcgccgcccggggctacatctccacccgcgtggagatgggcgaggccgcggggatcttcatgacggccacgccgcccggcagccgggacccgttcccccagtccaacgcccccatcatggacgaggagcgcgagatccccgagcggagctggaactccgggcacgagtgggtgaccgacttcaagggcaagaccgtctggttcgtgccgagcatcaaggccgggaacgacatcgcggcctgcctgcgcaagaacggcaagaaggtgatccagctgtcccggaagacgttcgacagcgagtacgtcaagacccgcgccaacgactgggacttcgtggtgaccaccgacatctccgagatgggcgccaacttcaaggccgagcgggtcatcgacccccgccggtgcatgaagcccgtgatcctcacggacggggaggagcgcgtgatcctggcgggccccatgccggtcacccacagctccgccgcccagcggcgcgggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccggaagaccttcgtggacctcatgcgccggggcgacctgcccgtctggctggcctacaaggtggccgccgaggggatcaactacgcggaccgcaagtggtgcttcgacggcatcaagaacaaccagatcctcgaggagaacatggaggtggagatctggacgaaggagggggagcggaagaagctgaagccgcgctggctggacgcccggatctactccgaccccctcgccctgaaggagttcaaggagttcgccgcgggccgcaagagcctgaccctcaacctgatcaccgagatgggccggctgcccaccttcatgacgcagaaggcccgcaacgccctcgacaacctggccgtcctgcacaccgccgaggccgggggccgggcctacaaccacgccctctccgagctgcccgagaccctggagaccctcctgctgctcacgctgctggccaccgtgaccgggggcatcttcctcttcctgatgagcggcaaggggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcgcacgccccaggacaaccagctcacctacgtggtgatcgccatcctgaccgtcgtggccgcgaccatggccaacgagatgggcttcctggagaagacgaagaaggacctcgggctgggctccatcaccacccaggagagcgagagcaacatcctggacatcgacctccggccggcctccgcctggaccctgtacgccgtggcgacgaccttcgtcacccccatgctgcgccacagcatcgagaactccagcgtgaacgtgtccctcaccgccatcgccaaccaggccacggtcctgatgggcctggggaagggctggcccctcagcaagatggacatcggggtgcccctgctggcgatcggctgctactcccaggtgaacccgatcaccctcaccgccgccctgctgctcctggtcgcccactacgccatcatcgggcccggcctgcaggcgaaggccacccgggaggcccagaagcgcgccgccgcgggcatcatgaagaaccccacggtggacgggatcaccgtgatcgacctcgagcccatcccgtacgaccccaagttcgagaagcagctgggccaggtcatgctgctcatcctgtgcgtgacccaggtgctgatgatgcggaccacgtgggccctctgcgaggccctgaccctggccaccgggcccatcagcaccctctgggagggcaaccccgggcgcttctggaacacgaccatcgccgtctccatggcgaacatcttccgcggcagctacctggccggcgccgggctcctgttctccatcatgaagaacaccaccaacacgcggcgcggcaccgggagcatcggcgagaccctgggcgagaagtggaagtcccggctgaacgccctcggcaagagcgagttccagatctacaagaagtccggcatccaggaggtggaccgcaccctggcgaaggaggggatcaagcggggcgagacggaccaccacgccgtgagccgcgggtccgccaagctgcggtggttcgtcgagcgcaacatggtgaccccggagggcaaggtggtcgacctcggctgcgggcggggcgggtggagctactactgcggcgggctgaagaacgtgcgcgaggtgaagggcctgaccaagggcgggcccggccacgaggagcccatccccatgtccacctacgggtggaacctcgtccggctgcagagcggcgtggacgtgttcttcacgccgcccgagaagtgcgacaccctgctctgcgacatcggggagagctcccccaaccccaccatcgaggccggccgcaccctgcgggtcctgaacctcgtggagaactggctgaacaacaacacccagttctgcatcaaggtgctgaacccgtacatgcccagcgtcatcgagaagatggaggccctccagcgcaagtacggcggggcgctggtgcggaaccccctgtcccgcaacagcacgcacgagatgtactgggtgtccaacgccaccggcaacatcgtcagctccgtgaacatgatcagccggatgctgatcaaccgcttcaccatgaagcacaagaaggccacctacgagccggacgtggacctcgggtccggcacgcggaacatcgggatcgagaacgagatccccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctcaccaagccctgggacgtcgtgccgatggtgacccagatggcgatgaccgacacgacccccttcgggcagcagcgggtcttcaaggagaaggtggacacccgcacccaggagcccaaggagggcacgaagaagctgatgaagatcaccgccgagtggctgtggaaggagctcggcaagaagaagacgccccggatgtgcacccgcgaggagttcacgcggaaggtgcgctccaacgccgccctgggggccatcttcaccgacgagaacaagtggaagtccgcgcgggaggccgtcgaggactcccgcttctgggagctggtggaccgggagcgcaacctccacctggagggcaagtgcgagacctgcgtgtacaacatgatggggaagcgggagaagaagctgggcgagttcgggaaggccaagggcagccgcgccatctggtacatgtggctcggcgcgcggttcctggagttcgaggccctggggttcctcaacgaggaccactggttctcccgcggcaacagcctgagcggggtcgagggcgaggggctgcaccggctcggctacatcctgcgcgacgtgggcaagaaggagggcggcgccatgtacgccgacgacaccgccgggtgggacacgcggatcaccctggaggacctcaagaacgaggagatggtcaccaaccacatgaagggcgagcacaagaagctggcggaggccatcttcaagctgacctaccagaacaaggtggtgcgcgtccagcggccgacgccccgcgggaccgtgatggacatcatctcccggcgcgaccagcgcggcagcggccaggtggggacctacggcctcaacaccttcacgaacatggaggcccagctgatccggcagatggagggggagggcatcttcaagtccatccagcacctgaccgccaccgaggagatcgccgtccagaactggctcgcgcgcgtgggccgggagcgcctgagccggatggccatctccggggacgactgcgtggtcaagcccatcgacgaccgcttcgccagcgccctgaccgccctcaacgacatgggcaaggtgcggaaggacatccagcagtgggagccctcccgcgggtggaacgactggacccaggtcccgttctgcagccaccacttccacgagctggtcatgaaggacggccgggtgctggtggtcccctgccgcaaccaggacgagctcatcgggcgggcgcgcatctcccagggcgccggctggagcctgaaggagaccgcctgcctggggaagtcctacgcccagatgtggaccctcatgtacttccaccggcgcgacctgcggctggccgcgaacgccatctgcagcgccgtgccctcccactgggtgcccaccagccgcaccacgtggtccatccacgccaagcacgagtggatgaccaccgaggacatgctcgcggtctggaaccgggtgtggatccaggagaacccgtggatggaggacaagacccccgtggagagctgggaggaggtcccctacctgggcaagcgcgaggaccagtggtgcgggtccctgatcggcctcacgagccgggccacctgggccaagaacatccagaccgccatcaaccaggtgcgcagcctgatcgggaacgaggagtacaccgactacatgccctccatgaagcgcttccggcgcgaggaggaggaggccggcgtgctgtggtga

SEQ ID NO: 9256 - RNA, 9876 nt, synthetic construct
  misc_feature 1..9876: note = derived and/or modified CDS sequence (opt1) from DENV-2__FJ850121__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtcttcggcgcgatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgcggggccctggcacctcggcaagctggagatggacttcgacctgtgcgaggggaccaccgtcgtggtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcatcggcacgaagcacgtcaccctcctggtggcggtgagcttcgtcaccctgatcaccgggaacatgtccttccgggacctcggccgcgtgatggtgatggtcggggccacgatgaccgacgacatcggcatgggcgtgacctacctggccctgctcgccgccttcaaggtgcgccccaccttcgcggccgggctgctgctccggaagctgacgagcaaggagctgatgatggccaccatcggcatcgccctcctgtcccagagcaccatccccgagaccatcctggagctcacggacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcaccatcctcgcggccgtctccgtgagccccctgctgctcacctccagccagcagaaggccgactggatccccctggccctgacgatcaagggcctcaaccccaccgcgatcttcctgaccaccctgtcccggacgagcaagaagcgctcctggccgctcaacgaggccatcatggccgtcggcatggtgagcatcctggcctccagcctgctcaagaacgacatccccatgaccgggcccctggtggccggcgggctgctcaccgtctgctacgtgctgaccggccggagcgcggacctggagctcgagcgcgccgccgacgtgaagtgggaggaccaggccgagatctccgggagctcccccatcctgagcatcacgatctccgaggacggcagcatgtccatcaagaacgaggaggaggagcagaccctgaccatcctcatccggaccggcctgctggtcatcagcggggtgttcccggtgtccatccccatcaccgccgcggcctggtacctctgggaggtcaagaagcagcgcgccggcgtgctgtgggacgtgcccagcccgccgcccgtcgagaaggccgagctggaggacggggcctaccggatcaagcagcgcggcatcctcgggtactcccagatcggcgcgggcgtgtacaaggaggggacgttccacaccatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgccgtgcagaccaagcccgggatcttcaagacgaacaccggcaccatcggggcggtgagcctcgacttctcccccggcaccagcggctcccccatcgtcgaccggaaggggaaggtggtgggcctgtacgggaacggcgtcgtgacgcgcagcggcgcctacgtgtccgccatcgcccagaccgagaagtccatcgaggacaaccccgagatcgaggacgacatcttccggaagaagcgcctgaccatcatggacctccaccccggggcgggcaagaccaagcggtacctgcccgccatcgtccgcgaggccatcaagcgggggctgcgcacgctgatcctcgccccgacccgcgtggtggccgcggagatggaggaggccctgcggggcctgcccatccgctaccagacccccgccatcaagaccgagcacacggggcgggagatcgtcgacctcatgtgccacgccaccttcaccatgcgcctgctgagccccgtgcgggtgccgaactacaacctcatcatcatggacgaggcccacttcaccgaccccgcgtccatcgccgcccgcggctacatcagcacgcgggtcgagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgaccgacttcaagggcaagacggtgtggttcgtcccgtccatcaaggccgggaacgacatcgccgcgtgcctgcggaagaacggcaagaaggtgatccagctgagccgcaagaccttcgactccgagtacgtgaagacccgggccaacgactgggacttcgtcgtgaccacggacatcagcgagatgggcgccaacttcaaggccgagcgcgtgatcgacccccggcgctgcatgaagcccgtcatcctcaccgacggggaggagcgggtgatcctggccggccccatgccggtgacccactccagcgcggcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgccatcgacggcgagtaccgcctgcgcggggaggcgcgcaagacgttcgtggacctcatgcggcgcggcgacctgcccgtgtggctggcctacaaggtcgccgccgaggggatcaactacgccgaccggaagtggtgcttcgacggcatcaagaacaaccagatcctcgaggagaacatggaggtggagatctggaccaaggagggggagcgcaagaagctgaagccgcggtggctggacgcgcgcatctacagcgaccccctcgccctgaaggagttcaaggagttcgccgccggccggaagtccctgaccctcaacctgatcaccgagatgggccgcctgcccacgttcatgacccagaaggcgcggaacgccctcgacaacctggccgtgctgcacaccgccgaggccgggggccgcgcgtacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgaccgtggtcgccgccacgatggcgaacgagatgggcttcctggagaagaccaagaaggacctcgggctgggcagcatcaccacccaggagagcgagtccaacatcctggacatcgacctccgcccggccagcgcctggacgctgtacgccgtggccaccaccttcgtgacccccatgctgcggcactccatcgagaacagctccgtcaacgtgagcctcacggcgatcgccaaccaggccaccgtgctgatgggcctggggaagggctggcccctctccaagatggacatcggggtccccctgctggccatcggctgctacagccaggtgaacccgatcaccctcaccgcggccctgctgctcctggtggcccactacgccatcatcgggcccggcctgcaggccaaggcgacgcgcgaggcccagaagcgggccgccgccggcatcatgaagaaccccaccgtcgacgggatcaccgtgatcgacctcgagcccatcccgtacgaccccaagttcgagaagcagctgggccaggtgatgctgctcatcctgtgcgtcacccaggtgctgatgatgcgcacgacctgggcgctctgcgaggccctgaccctggccaccgggcccatctccacgctctgggagggcaaccccgggcggttctggaacaccaccatcgccgtgagcatggccaacatcttccgcggctcctacctggcgggcgccgggctcctgttcagcatcatgaagaacaccacgaacacccgccggggcaccgggaacatcggcgagaccctgggcgagaagtggaagtcccgcctgaacgccctcggcaagagcgagttccagatctacaagaagtccggcatccaggaggtcgaccggacgctggccaaggaggggatcaagcgcggcgagaccgaccaccacgcggtgagccgggggtccgccaagctgcgctggttcgtggagcggaacatggtcaccccggagggcaaggtggtggacctcggctgcgggcgcggcgggtggagctactactgcggcgggctgaagaacgtccgggaggtgaagggcctgaccaagggcgggcccggccacgaggagcccatccccatgtccacgtacgggtggaacctcgtgcgcctgcagagcggcgtcgacgtgttcttcaccccgcccgagaagtgcgacaccctgctctgcgacatcggggagagctcccccaaccccaccatcgaggccggccggaccctgcgcgtgctgaacctcgtcgagaactggctgaacaacaacacgcagttctgcatcaaggtgctgaacccgtacatgcccagcgtgatcgagaagatggaggccctccagcggaagtacggcggggccctggtccgcaaccccctgtcccggaacagcacccacgagatgtactgggtgtccaacgcgaccggcaacatcgtgagctccgtcaacatgatcagccgcatgctgatcaaccggttcaccatgaagcacaagaaggccacgtacgagccggacgtggacctcgggtccggcacccgcaacatcgggatcgagagcgagatccccaacctggacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtcccgatggtgacccagatggccatgacggacaccacccccttcgggcagcagcgcgtgttcaaggagaaggtcgacacccggacgcaggagcccaaggagggcaccaagaagctgatgaagatcaccgcggagtggctgtggaaggagctcggcaagaagaagacgccccgcatgtgcacgcgggaggagttcacccgcaaggtgcggagcaacgccgccctgggggccatcttcaccgacgagaacaagtggaagtccgcccgcgaggcggtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggccatctggtacatgtggctcggggcccgcttcctggagttcgaggcgctgggcttcctcaacgaggaccactggttctcccgggggaacagcctgagcggcgtggagggggagggcctgcaccgcctcggctacatcctgcgggacgtcgggaagaaggagggcggggccatgtacgccgacgacacggccggctgggacacccgcatcaccctggaggacctcaagaacgaggagatggtgaccaaccacatgaagggggagcacaagaagctggccgaggcgatcttcaagctgacgtaccagaacaaggtcgtgcgggtgcagcgcccgacgccccggggcaccgtcatggacatcatctcccgccgggaccagcgcggcagcgggcaggtcggcacctacgggctcaacacgttcaccaacatggaggcccagctgatccgccagatggagggcgagggcatcttcaagtccatccagcacctgaccgccaccgaggagatcgccgtgcagaactggctcgcccgggtcgggcgcgagcggctgagccgcatggcgatctccggcgacgactgcgtggtgaagcccatcgacgaccggttcgccagcgccctgacggccctcaacgacatggggaaggtccgcaaggacatccagcagtgggagccctcccggggctggaacgactggacccaggtgccgttctgcagccaccacttccacgagctggtgatgaaggacgggcgcgtcctggtggtgccctgccggaaccaggacgagctcatcggccgcgcccggatctcccagggcgcggggtggagcctgaaggagaccgcctgcctgggcaagtcctacgcccagatgtggaccctcatgtacttccaccgccgggacctgcgcctggccgccaacgcgatctgcagcgccgtgccgccccactgggtgccgacctcccggacgacctggagcatccacgccaagcacgagtggatgaccaccgaggacatgctcgccgtgtggaaccgcgtctggatccaggagaacccctggatggaggacaagacgcccgtggagtcctgggaggaggtgccctacctggggaagcgggaggaccagtggtgcggcagcctgatcgggctcacctcccgcgcgacctgggccaagaacatccagaccgccatcaaccaggtccggagcctgatcggcaacgaggagtacacggactacatgccgagcatgaagcgcttccgccgggaggaggaggaggccggcgtgctgtggtga

SEQ ID NO: 9257 - RNA, 9876 nt, synthetic construct
  misc_feature 1..9876: note = derived and/or modified CDS sequence (opt1) from DENV-2__GQ199897__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtcctcaagatcgtgcgcaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtcgtgagcggggtgttcccggtctccatccccatcaccgcggccgcctggtacctctgggaggtgaagaagcagcgcgccggcgtgctgtgggacgtccccagcccgccgcccgtggagaaggccgagctggaggacggggcgtaccggatcaagcagcgcggcatcctcgggtactcccagatcggcgccggcgtgtacaaggaggggaccttccacacgatgtggcacgtcacccggggcgccgtgctgatgcaccgcgggaagcggatcgagcccagctgggccgacgtgaagaaggacctgatctcctacggcgggggctggaagctcgagggcgagtggaaggagggggaggaggtccaggtgctggccctggagcccggcaagaacccccgcgcggtgcagaccaagcccgggatcttcaagaccaacacgggcaccatcggggccgtcagcctcgacttctcccccggcaccagcggctcccccatcgtggaccggaaggggaaggtggtcggcctgtacgggaacggcgtggtgacccgcagcggcgcctacgtctccgccatcgcgcagacggagaagtccatcgaggacaaccccgagatcgaggacgacatcttccggaagaagcgcctgaccatcatggacctccaccccggggccggcaagaccaagcggtacctgcccgccatcgtgcgcgaggccatcaagcgggggctgcgcaccctgatcctcgccccgacgcgcgtggtcgcggccgagatggaggaggccctgcggggcctgcccatccgctaccagacccccgccatcaagaccgagcacaccgggcgggagatcgtggacctcatgtgccacgccacgttcaccatgcgcctgctgagccccgtgcgggtcccgaactacaacctcatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctgcggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctcacggacggggaggagcgggtgatcctggcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtggacgcgatcgacggcgagtaccgcctgcgcggggaggcccgcaagaccttcgtggacctcatgcggcgcggcgacctgcccgtctggctggcctacaaggtggccgccgaggggatcaactacgcggaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtcctgcacaccgccgaggccgggggccgcgcctacaaccacgccctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtgatcgccatcctgaccgtcgtggccgcgaccatggccaacgagatgggcttcctggagaagacgaagaaggacctcgggctgggcagcatcaccacccaggagagcgagtccaacatcctggacatcgacctccgcccggccagcgcctggaccctgtacgccgtggcgacgaccttcgtcacccccatgctgcggcactccatcgagaacagctccgtgaacgtgagcctcaccgccatcgccaaccaggccacggtcctgatgggcctggggaagggctggcccctctccaagatggacatcggggtgcccctgctggcgatcggctgctacagccaggtgaacccgatcaccctcaccgccgccctgctgctcctggtcgcccactacgccatcatcgggcccggcctgcaggcgaaggccacccgcgaggcccagaagcgggccgccgcgggcatcatgaagaaccccacggtggacgggatcaccgtgatcgacctcgagcccatcccgtacgaccccaagttcgagaagcagctgggccaggtcatgctgctcatcctgtgcgtgacccaggtgctgatgatgcgcaccacgtgggccctctgcgaggccctgaccctggccaccgggcccatctccaccctctgggagggcaaccccgggcggttctggaacacgaccatcgccgtcagcatggcgaacatcttccgcggctcctacctggccggcgccgggctcctgttcagcatcatgaagaacaccaccaacacgcgccggggcaccgggaacatcggcgagaccctgggcgagaagtggaagtcccgcctgaacgccctcggcaagagcgagttccagatctacaagaagtccggcatccaggaggtggaccggaccctggcgaaggaggggatcaagcgcggcgagacggaccaccacgccgtgagccgggggtccgccaagctgcgctggttcgtcgagcggaacatggtgaccccggagggcaaggtggtcgacctcggctgcgggcgcggcgggtggagctactactgcggcgggctgaagaacgtgcgggaggtgaagggcctgaccaagggcgggcccggccacgaggagcccatccccatgtccacctacgggtggaacctcgtccgcctgcagagcggcgtggacgtgttcttcacgccgcccgagaagtgcgacaccctgctctgcgacatcggggagagctcccccaaccccaccatcgaggccggccggaccctgcgcgtcctgaacctcgtggagaactggctgaacaacaacacccagttctgcatcaaggtgctgaacccgtacatgcccagcgtcatcgagaagatggaggccctccagcggaagtacggcggggcgctggtgcgcaaccccctgtcccggaacagcacgcacgagatgtactgggtgtccaacgccaccggcaacatcgtcagctccgtgaacatgatcagccgcatgctgatcaaccggttcaccatgaagcacaagaaggccacctacgagccggacgtggacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgccagctccatggtcaacggcgtggtgcgcctgctcaccaagccctgggacgtcgtgccgatggtgacccagatggcgatgaccgacacgacccccttcgggcagcagcgcgtcttcaaggagaaggtggacacccggacccaggagcccaaggagggcacgaagaagctgatgaagatcaccgccgagtggctgtggaaggagctcggcaagaagaagacgccccgcatgtgcacccgggaggagttcacgcgcaaggtgcggagcaacgccgccctgggggccatcttcaccgacgagaacaagtggaagtccgcgcgcgaggccgtcgaggacggccggttctgggagctggtggaccgcgagcggaacctccacctggaggggaagtgcgagacctgcgtgtacaacatgatgggcaagcgcgagaagaagctgggggagttcggcaaggccaagggcagccgggccatctggtacatgtggctcggggcgcgcttcctggagttcgaggccctgggcttcctcaacgaggaccactggttctcccgggggaacagcctgagcggcgtcgagggggagggcctgcaccgcctcggctacatcctgcgggacgtggggaagaaggagggcggggccatgtacgccgacgacaccgccggctgggacacgcgcatcaccctggaggacctcaagaacgaggagatggtcaccaaccacatgaagggggagcacaagaagctggcggaggccatcttcaagctgacctaccagaacaaggtggtgcgggtccagcgcccgacgccccggggcaccgtgatggacatcatctcccgccgggaccagcgcggcagcgggcaggtcggcacctacgggctcaacaccttcacgaacatggaggcccagctgatccgccagatggagggcgagggcatcttcaagtccatccagcacctgaccgccaccgaggagatcgccgtccagaactggctcgcgcgggtggggcgcgagcggctgagccgcatggccatctccggcgacgactgcgtggtcaagcccatcgacgaccggttcgccagcgccctgaccgccctcaacgacatggggaaggtgcgcaaggacatccagcagtgggagccctcccggggctggaacgactggacccaggtgccgttctgcagccaccacttccacgagctggtcatgaaggacgggcgcgtgctggtggtcccctgccggaaccaggacgagctcatcggccgcgcgcggatctcccagggcgccgggtggagcctgaaggagaccgcctgcctgggcaagtcctacgcccagatgtggaccctcatgtacttccaccgccgggacctgcgcctggccgcgaacgccatctgcagcgccgtgccgccccactgggtgccgacctcccggaccacgtggagcatccacgccaagcacgagtggatgaccaccgaggacatgctcgcggtctggaaccgcgtgtggatccaggagaacccctggatggaggacaagacccccgtggagtcctgggaggaggtcccctacctggggaagcgggaggaccagtggtgcggcagcctgatcgggctcacgtcccgcgccacctgggccaagaacatccagaccgccatcaaccaggtgcggagcctgatcggcaacgaggagtacaccgactacatgccgagcatgaagcgcttccgccgggaggaggaggaggccggcgtgctgtggtga

SEQ ID NO: 9258 - RNA, 9876 nt, synthetic construct
  misc_feature 1..9876: note = derived and/or modified CDS sequence (opt1) from DENV-2__GQ199895__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtcctcaagatcgtgcgcaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgccatcgcgcagacggagaagtccatcgaggacaaccccgagatcgaggaggacatcttccggaagaagcgcctgaccatcatggacctccaccccggggccggcaagaccaagcggtacctgcccgccatcgtccgcgaggccatcaagcgggggctgcgcaccctgatcctcgccccgacgcgcgtggtggcggccgagatggaggaggccctgcggggcctgcccatccgctaccagacccccgccatcaagaccgagcacaccgggcgggagatcgtcgacctcatgtgccacgccacgttcaccatgcgcctgctgagccccgtgcgggtgccgaactacaacctcatcatcatggacgaggcgcacttcaccgaccccgcctccatcgccgcccgcggctacatcagcacccgggtcgagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggccgagcgcgtgatcgacccccggcgctgcatgaagcccgtcatcctcacggacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagaccttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtgctgcacaccgccgaggccgggggccgcgcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccgcccggccagcgcctggaccctgtacgccgtggcgacgaccttcgtgacccccatgctgcggcactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgccgtgagcatggcgaacatcttccgcggctcctacctggccggcgccgggctcctgttcagcatcatgaagaacaccaccaacacgcgccggggcaccgggaacatcggcgagaccctgggcgagaagtggaagtcccgcctgaacgccctcggcaagagcgagttccagatctacaagaagtccggcatccaggaggtcgaccggaccctggcgaaggaggggatcaagcgcggcgagacggaccaccacgccgtgagccgggggtccgccaagctgcgctggttcgtggagcggaacatggtcaccccggagggcaaggtggtggacctcggctgcgggcgcggcgggtggagctactactgcggcgggctgaagaacgtccgggaggtgaagggcctgaccaagggcgggcccggccacgaggagcccatccccatgtccacctacgggtggaacctcgtgcgcctgcagagcggcgtcgacgtgttcttcacgccgcccgagaagtgcgacaccctgctctgcgacatcggggagagctcccccaaccccaccatcgaggccggccggaccctgcgcgtgctgaacctcgtcgagaactggctgaacaacaacacccagttctgcatcaaggtgctgaacccgtacatgcccagcgtgatcgagaagatggaggccctccagcggaagtacggcggggcgctggtccgcaaccccctgtcccggaacagcacgcacgagatgtactgggtgtccaacgccaccggcaacatcgtgagctccgtcaacatgatcagccgcatgctgatcaaccggttcaccatgaagcacaagaaggccacctacgagccggacgtggacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccctgggacgtggtcccgatggtgacccagatggcgatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagacgccccgcatgtgcacccgggaggagttcacgcgcaaggtgcggagcaacgccgccctgggggccatcttcaccgacgagaacaagtggaagtccgcgcgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggcagccgggccatctggtacatgtggctcggggcgcgcttcctggagttcgaggccctgggcttcctcaacgaggaccactggttctcccgggggaacagcctgagcggcgtggagggggagggcctgcaccgcctcggctacatcctgcgggacgtcgggaagaaggagggcggggccatgtacgccgacgacaccgccggctgggacacgcgcatcaccctggaggacctcaagaacgaggagatggtgaccaaccacatgaagggggagcacaagaagctggcggaggccatcttcaagctgacctaccagaacaaggtcgtgcgggtgcagcgcccgacgccccggggcaccgtcatggacatcatctcccgccgggaccagcgcggcagcgggcaggtcggcacctacgggctcaacaccttcacgaacatggaggcccagctgatccgccagatggagggcgagggcatcttcaagtccatccagcacctgaccgccaccgaggagatcgccgtgcagaactggctcgcgcgggtcgggcgcgagcggctgagccgcatggccatctccggcgacgactgcgtggtgaagcccatcgacgaccggttcgccagcgccctgaccgccctcaacgacatggggaaggtccgcaaggacatccagcagtgggagccctcccggggctggaacgactggacccaggtcccgttctgcagccaccacttccacgagctggtgatgaaggacgggcgcgtcctggtggtgccctgccggaaccaggacgagctcatcggccgcgcgcggatctcccagggcgccgggtggagcctgaaggagaccgcctgcctgggcaagtcctacgcccagatgtggaccctcatgtacttccaccgccgggacctgcgcctggccgcgaacgccatctgcagcgccgtgccgccccactgggtgccgacctcccggaccacgtggagcatccacgccaagcacgagtggatgaccaccgaggacatgctcgcggtgtggaaccgcgtctggatccaggagaacccctggatggaggacaagacccccgtggagtcctgggaggaggtgccctacctggggaagcgggaggaccagtggtgcggcagcctgatcgggctcacgtcccgcgccacctgggccaagaacatccagaccgccatcaaccaggtccggagcctgatcggcaacgaggagtacaccgactacatgccgagcatgaagcgcttccgccgggaggaggaggaggccggcgtgctgtggtga

SEQ ID NO: 9259 - RNA, 9876 nt, synthetic construct
  misc_feature 1..9876: note = derived and/or modified CDS sequence (opt1) from DENV-2__FJ898478__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtcctcaagatcgtgcgcaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgccatcgcgcagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcaccctgatcctcgccccgacgcgcgtggtggcggccgagatggaggaggccctgcggggcctgcccatccgctaccagacccccgccatcaagaccgagcacaccgggcgggagatcgtcgacctcatgtgccacgccacgttcaccatgcgcctgctgagccccgtgcgggtgccgaactacaacctcatcatcatggacgaggcgcacttcaccgaccccgcctccatcgccgcccgcggctacatcagcacccgggtcgagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggccgagcgcgtgatcgacccccggcgctgcatgaagcccgtcatcctcacggacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagaccttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtgctgcacaccgccgaggccgggggccgcgcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccgcccggccagcgcctggaccctgtacgccgtggcgacgaccttcgtgacccccatgctgcggcactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgccgtgagcatggcgaacatcttccgcggctcctacctggccggcgccgggctcctgttcagcatcatgaagaacaccacctccacgcgccggggcaccgggaacatcggcgagaccctgggcgagaagtggaagtcccgcctgaacgccctcgggaagtccgagttccagatctacaagaagtccggcatccaggaggtcgaccggaccctggcgaaggaggggatcaagcgcggcgagacggaccaccacgccgtgtcccgggggagcgccaagctgcgctggttcgtggagcggaacatggtcaccccggagggcaaggtggtggacctcggctgcgggcgcggcgggtggtcctactactgcggcgggctgaagaacgtccgggaggtgaagggcctgaccaagggcgggcccggccacgaggagcccatccccatgagcacctacgggtggaacctcgtgcgcctgcagagcggcgtcgacgtgttcttcacgccgcccgagaagtgcgacaccctgctctgcgacatcggggagtccagccccaaccccaccatcgaggccggccggaccctgcgcgtgctgaacctcgtcgagaactggctgaacaacaacacccagttctgcatcaaggtgctgaacccgtacatgccctccgtgatcgagaagatggaggccctccagcggaagtacggcggggcgctggtccgcaaccccctgagccggaactccacgcacgagatgtactgggtgagcaacgccaccggcaacatcgtgtccagcgtcaacatgatctcccgcatgctgatcaaccggttcaccatgaagcacaagaaggccacctacgagccggacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtggtcccgatggtgacccagatggcgatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagacgccccgcatgtgcacccgggaggagttcacgcgcaaggtgcggtccaacgccgccctgggggccatcttcaccgacgagaacaagtggaagtccgcgcgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtggagggggagggcctgcaccgcctcggctacatcctgcgggacgtcgggaagaaggagggcggggccatgtacgccgacgacaccgccggctgggacacgcgcatcaccctggaggacctcaagaacgaggagatggtgaccaaccacatgaagggggagcacaagaagctggcggaggccatcttcaagctgacctaccagaacaaggtcgtgcgggtgcagcgcccgacgccccggggcaccgtcatggacatcatcagccgccgggaccagcgcggctccgggcaggtcggcacctacgggctcaacaccttcacgaacatggaggcccagctgatccgccagatggagggcgagggcatcttcaagagcatccagcacctgaccgccaccgaggagatcgccgtgcagaactggctcgcgcgggtcgggcgcgagcggctgtcccgcatggccatcagcggcgacgactgcgtggtgaagcccatcgacgaccggttcgcctccgccctgaccgccctcaacgacatggggaaggtccgcaaggacatccagcagtgggagcccagccggggctggaacgactggacccaggtgccgttctgctcccaccacttccacgagctggtgatgaaggacgggcgcgtcctggtggtgccctgccggaaccaggacgagctcatcggccgcgcgcggatcagccagggcgccgggtggtccctgaaggagaccgcctgcctgggcaagagctacgcccagatgtggaccctcatgtacttccaccgccgggacctgcgcctggccgcgaacgccatctgctccgccgtccccagccactgggtgcccacctcccggaccacgtggagcatccacgccaagcacgagtggatgaccaccgaggacatgctcgcggtgtggaaccgcgtctggatccaggagaacccgtggatggaggacaagacccccgtggagtcctgggaggaggtgccctacctggggaagcgggaggaccagtggtgcggcagcctgatcgggctcacgagccgcgccacctgggccaagaacatccagaccgccatcaaccaggtccggtccctgatcggcaacgaggagtacaccgactacatgcccagcatgaagcgcttccgccgggaggaggaggaggccggcgtgctgtggtga

SEQ ID NO: 9260 - RNA, 9876 nt, synthetic construct
  misc_feature 1..9876: note = derived and/or modified CDS sequence (opt1) from DENV-2__GQ199869__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacatccagggcagcaactggatccagaaggagaccctggtgacgttcaagaacccccacgcgaagaagcaggacgtcgtggtcctcgggtcccaggagggcgccatgcacaccgccctgaccggggccaccgagatccagatgagcagcggcaacctcctgttcacgggccacctgaagtgccgcctgcggatggacaagctccagctgaaggggatgtcctacagcatgtgcaccggcaagttcaagatcgtgaaggagatcgccgagacccagcacgggaccatcgtgatccgcgtccagtacgagggcgacggctccccctgcaagatccccttcgagatcacggacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggaccatgaagatcctgatcggcgtcatcatcacgtggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtcaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtgttcacgaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtggtcgtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcaccaagcacgcgatcctgctcgtggccgtcagcttcgtgacgctgatcaccgggaacatgtccttccgggacctgggccgcgtgatggtcatggtgggggccaccatgaccgacgacatcggcatgggcgtgacgtacctcgccctgctggccgcgttcaaggtccgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtgctgaagatcgtgcgcaacatggagaagtaccagctcgccgtcaccatcatggccatctcctgcgtgccgaacgccgtgatcctgcagaacgcgtggaaggtcagctgcacgatcctggccgccgtgtccgtcagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtgggcatggtgagcatcctcgcctccagcctgctgaagaacgacatccccatgaccgggcccctcgtcgcgggcgggctgctgacggtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagaccctgacgatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacaccatgtggcacgtcacgcggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacaccggcacgatcggggccgtcagcctggacttctcccccggcaccagcggctcccccatcgtggaccggaaggggaaggtggtcggcctctacgggaacggcgtggtgacccgcagcggcgcctacgtctccgccatcgcgcagaccgagaagtccatcgaggacaaccccgagatcgaggacgacatcttccggaagaagcgcctgacgatcatggacctgcaccccggggccggcaagaccaagcggtacctccccgccatcgtgcgcgaggccatcaagcgggggctgcgcaccctgatcctggccccgacccgcgtggtcgcggccgagatggaggaggccctccggggcctgcccatccgctaccagacgcccgccatcaagaccgagcacaccgggcgggagatcgtggacctgatgtgccacgccaccttcacgatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagaccttcgactccgagtacgtcaagacgcgggccaacgactgggacttcgtggtgaccaccgacatcagcgagatgggcgccaacttcaaggccgagcgcgtcatcgacccccggcgctgcatgaagcccgtgatcctgaccgacggggaggagcgggtgatcctcgcgggccccatgccggtcacgcactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggaccaaggagggggagcgcaagaagctcaagccgcggtggctggacgcccgcatctacagcgaccccctggccctcaaggagttcaaggagttcgccgcgggccggaagtccctgacgctgaacctcatcaccgagatgggccgcctgcccaccttcatgacccagaaggcccggaacgccctggacaacctcgccgtcctgcacacggccgaggccgggggccgcgcctacaaccacgccctgagcgagctccccgagaccctggagaccctgctcctgctgaccctcctggccacggtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacgtacgtggtgatcgccatcctcaccgtcgtggccgcgaccatggccaacgagatgggcttcctggagaagaccaagaaggacctggggctcggcagcatcacgacccaggagagcgagtccaacatcctggacatcgacctgcgcccggccagcgcctggaccctctacgccgtggcgaccacgttcgtcacccccatgctgcggcactccatcgagaacagctccgtgaacgtgagcctgaccgccatcgccaaccaggccaccgtcctcatgggcctggggaagggctggcccctgtccaagatggacatcggggtgcccctcctggcgatcggctgctacagccaggtgaacccgatcacgctgaccgccgccctcctgctgctcgtcgcccactacgccatcatcgggcccggcctgcaggcgaaggccacccgcgaggcccagaagcgggccgccgcgggcatcatgaagaaccccaccgtggacgggatcacggtgatcgacctggagcccatcccgtacgaccccaagttcgagaagcagctcggccaggtcatgctgctgatcctctgcgtgacccaggtgctgatgatgcgcaccacctgggccctgtgcgaggccctcacgctggccaccgggcccatctccaccctgtgggagggcaaccccgggcggttctggaacaccacgatcgccgtcagcatggcgaacatcttccgcggctcctacctcgccggcgccgggctgctgttcagcatcatgaagaacaccacctccacccgccggggcacggggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagaccgaccaccacgccgtgtcccgggggagcgccaagctgcgctggttcgtcgagcggaacatggtgacgccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacctacgggtggaacctggtccgcctccagagcggcgtggacgtgttcttcaccccgcccgagaagtgcgacacgctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacccacgagatgtactgggtgagcaacgccacgggcaacatcgtctccagcgtgaacatgatctcccgcatgctgatcaaccggttcaccatgaagcacaagaaggccacctacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacgtgggcctaccacggctcctacgagaccaagcagaccgggagcgcctccagcatggtcaacggcgtggtgcgcctgctgaccaagccctgggacgtcgtgccgatggtgacgcagatggcgatgaccgacaccacccccttcgggcagcagcgcgtcttcaaggagaaggtggacacgcggacccaggagcccaaggagggcaccaagaagctcatgaagatcaccgccgagtggctgtggaaggagctgggcaagaagaagacgccccgcatgtgcacccgggaggagttcaccaagaaggtgcgctccaacgccgccctcggggccatcttcaccgacgagaacaagtggaagtccgcgcgggaggccgtcgaggacggccgcttctgggagctggtggaccgggagcgcaacctgcacctcgaggggaagtgcgagacgtgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacccggatcaccctggaggacctgaagaacgaggagatggtcacgaaccacatgaagggggagcacaagaagctcgcggaggccatcttcaagctgacctaccagaacaaggtggtgcgcgtccagcggccgacgccccgcggcaccgtgatggacatcatcagccggcgcgaccagcggggctccgggcaggtcggcacgtacgggctgaacaccttcaccaacatggaggcccagctcatccgccagatggagggcgagggcatcttcaagagcatccagcacctgaccgccacggaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagaccgcctgcctgggcaagagctacgcccagatgtggacgctgatgtacttccaccggcgcgacctccggctggccgcgaacgccatctgctccgccgtgcccagccactgggtgcccacctcccgcaccacctggagcatccacgccaagcacgagtggatgaccacggaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacctgggccaagaacatccagacggccatcaaccaggtgcgctccctcatcggcaacgaggagtacaccgactacatgcccagcatgaagcggttccgccgcgaggaggaggaggccggcgtgctgtggtga

SEQ ID NO: 9261 - RNA, 9876 nt, synthetic construct
  misc_feature 1..9876: note = derived and/or modified CDS sequence (opt1) from DENV-2__JX079688__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggcacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatgggcctggggaagggctggcccctgtccaagatggacatcggggtgcccctcctggcgatcggctgctacagccaggtgaacccgatcaccctgaccgccgccctcctgctgctcgtcgcccactacgccatcatcgggcccggcctgcaggcgaaggccacccgcgaggcccagaagcgggccgccgcgggcatcatgaagaaccccacggtggacgggatcaccgtgatcgacctggagcccatcccgtacgaccccaagttcgagaagcagctcggccaggtcatgctgctgatcctctgcgtgacccaggtgctgatgatgcgcaccacgtgggccctgtgcgaggccctcaccctggccaccgggcccatctccaccctgtgggagggcaaccccgggcggttctggaacacgaccatcgccgtcagcatggcgaacatcttccgcggctcctacctcgccggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagacggaccaccacgccgtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacctacgggtggaacctggtccgcctccagagcggcgtggacgtgttcttcacgccgcccgagaagtgcgacaccctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacgcacgagatgtactgggtgagcaacgccaccggcaacatcgtctccagcgtgaacatgatctcccgcatgctgatcaaccggttcaccatgaagcacaagaaggccacctacgagccggacgtggacctggggagcggcacgcgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagaccgggagcgcctccagcatggtcaacggcgtggtgcgcctgctgacgaagccctgggacgtcgtgccgatggtgacccagatggcgatgaccgacaccacgcccttcgggcagcagcgcgtcttcaaggagaaggtggacacccggacccaggagcccaaggagggcaccaagaagctcatgaagatcacggccgagtggctgtggaaggagctgggcaagaagaagacgccccgcatgtgcacccgggaggagttcaccaagaaggtgcgctccaacgccgccctcggggccatcttcacggacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacccggatcacgctggaggacctgaagaacgaggagatggtcaccaaccacatgaagggggagcacaagaagctcgcggaggccatcttcaagctgacctaccagaacaaggtggtgcgcgtccagcggccgacgccccgcggcacggtgatggacatcatcagccggcgcgaccagcggggctccgggcaggtcggcacctacgggctgaacaccttcaccaacatggaggcccagctcatccgccagatggagggcgagggcatcttcaagagcatccagcacctgacggccaccgaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagacggcctgcctgggcaagagctacgcccagatgtggaccctgatgtacttccaccggcgcgacctccggctggccgcgaacgccatctgctccgccgtgcccagccactgggtgcccacctcccgcaccacctggagcatccacgccaagcacgagtggatgacgaccgaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacgtgggccaagaacatccagaccgccatcaaccaggtgcgctccctcatcggcatcgaggagtacaccgactacatgcccagcatgaagcggttccgccgcgaggaggaggaggccggcgtgctgtggtga

SEQ ID NO: 9262 - RNA, 9876 nt, synthetic construct
  misc_feature 1..9876: note = derived and/or modified CDS sequence (opt1) from DENV-2__JF357906__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcggtgctggcctacaccatcgggaccacgcacttccagaaggccctcatcttcatcctgctgaccgccgtcgcgcccagcatgaccatgcggtgcatcggcatcagcaaccgcgacttcgtggagggcgtgagcgggggcagctgggtcgacatcgtgctcgagcacgggagctgcgtgaccacgatggccaagaacaagcccaccctggacttcgagctgatcaagaccgaggccaagcagcccgccaccctccggaagtactgcatcgaggccaagctgacgaacaccaccaccgagtcccgctgcccgacgcagggcgagcccagcctgaacgaggagcaggacaagcggttcatctgcaagcactccatggtcgaccgcggctgggggaacggctgcgggctgttcggcaagggcgggatcgtgacctgcgcgatgttcacgtgcaagaagaacatggagggcaaggtggtccagcccgagaacctggagtacaccatcgtgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccggaccggcctcgacttcaacgagatggtgctgctgcagatggaggacaaggcctggctcgtgcaccgccagtggttcctggacctgcccctcccctggctgccgggggccgacacccagggcagcaactggatccagaaggagacgctggtcaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtcatccgggtgcagtacgagggcgacggctccccctgcaagatccccttcgagatcaccgacctggagaagcgccacgtgctcgggcggctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagacgaccatgcgcggcgccaagcgcatggccatcctgggggacaccgcctgggacttcggcagcctcggcggggtgttcacctccatcgggaaggccctccaccaggtgttcggggcgatctacggcgccgccttcagcggggtctcctggacgatgaagatcctgatcggcgtgatcatcacctggatcgggatgaacagccggtccaccagcctgtccgtgagcctggtcctcgtgggcgtggtcaccctgtacctgggggccgtggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccgcagcgtcacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccggccgggctaccacacgcagaccgcggggccctggcacctcggcaagctggagatggacttcgacttctgcgaggggaccaccgtcgtggtgacggaggactgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtcaacagcctggtgaccgccgggcacggccagatcgacaacttctccctcggcgtgctggggatggccctgttcctcgaggagatgctgcgcacccggatcggcacgaagcacgcgatcctgctcgtcgccgtgagcttcgtgaccctgatcaccgggaacatgtccttccgcgacctgggccgggtcatggtgatggtgggggccaccatgacggacgacatcggcatgggcgtcacctacctcgccctgctggccgcgttcaaggtgcgccccaccttcgccgccgggctcctgctgcgcaagctcaccagcaaggagctgatgatggccacgatcggcatcgccctgctctcccagagcaccatccccgagaccatcctggagctgaccgacgcgctcgccctggggatgatggtgctgaagatcgtccggaacatggagaagtaccagctcgccgtgacgatcatggccatctcctgcgtgccgaacgccgtcatcctgcagaacgcgtggaaggtgagctgcaccatcctggccgccgtctccgtgagccccctcctgctgacctccagccagcagaaggccgactggatccccctcgcgctgaccatcaagggcctgaaccccacggccatcttcctcaccaccctgtcccgcaccagcaagaagcggtcctggccgctgaacgaggccatcatggccgtgggcatggtcagcatcctcgcctccagcctgctgaagaacgacatccccatgacggggcccctcgtggcgggcgggctgctgaccgtgtgctacgtcctcaccggccgcagcgccgacctggagctggagcgggccgccgacgtgaagtgggaggaccaggccgagatctccgggagctcccccatcctcagcatcaccatctccgaggacggcagcatgtccatcaagaacgaggaggaggagcagacgctgaccatcctgatccgcaccggcctcctggtgatcagcgggatcttcccggtctccatccccatcaccgcggccgcctggtacctgtgggaggtgaagaagcagcgggccggcgtgctctgggacgtccccagcccgccgcccgtggagaaggccgagctggaggacggggcgtaccgcatcaagcagcggggcatcctggggtactcccagatcggcgccggcgtgtacaaggaggggaccttccacacgatgtggcacgtcacccgcggcgccgtgctcatgcaccgggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagaccaagcccgggatcttcaagaccaacacgggcaccatcggggccgtcagcctggacttctcccccggcaccagcggctcccccatcgtggaccgcaaggggaaggtggtcggcctctacgggaacggcgtggtgacccggagcggcgcctacgtctccgccatcgcgcagacggagaagtccatcgaggacaaccccgagatcgaggacgacatcttccgcaagaagcggctgaccatcatggacctgcaccccggggccggcaagaccaagcgctacctccccgccatcgtgcgggaggccatcaagcgcgggctgcggaccctgatcctggccccgacgcgcgtggtcgcggccgagatggaggaggccctccgcggcctgcccatccggtaccagacccccgccatcaagaccgagcacaccgggcgcgagatcgtggacctgatgtgccacgccacgttcaccatgcggctcctgagccccgtgcgcgtcccgaactacaacctgatcatcatggacgaggcgcacttcaccgaccccgcctccatcgccgcccggggctacatcagcacccgcgtggagatgggcgaggccgcggggatcttcatgacggccacgccgcccggctcccgggacccgttcccccagagcaacgcccccatcatggacgaggagcgcgagatccccgagcggtcctggaacagcgggcacgagtgggtgaccgacttcaagggcaagaccgtctggttcgtgccgtccatcaaggccgggaacgacatcgcggcctgcctccgcaagaacggcaagaaggtgatccagctgagccggaagacgttcgactccgagtacgtcaagacccgcgccaacgactgggacttcgtggtgaccaccgacatcagcgagatgggcgccaacttcaaggccgagcgggtcatcgacccccgccggtgcatgaagcccgtgatcctgacggacggggaggagcgcgtgatcctcgcgggccccatgccggtcacccactccagcgccgcccagcggcgcgggcggatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgcgagaaggtggacgcgatcgacggcgagtaccggctgcgcggggaggcccggaagaccttcgtggacctgatgcgccggggcgacctccccgtctggctggcctacaaggtggccgccgaggggatcaactacacggaccgcaagtggtgcttcgacggcatcaagaacaaccagatcctggaggagaacatggaggtggagatctggaccaaggagggggagcggaagaagctcaagccgcgctggctggacgcgcggatctacagcgaccccctggccctcaaggagttcaaggagttcgccgccggccgcaagtccctgaccctgaacctcatcaccgagatgggccggctgcccacgttcatgacccagaaggcgcgcaacgccctggacaacctcgccgtcctgcacaccgccgaggccgggggccgggcgtacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggccagcatcctgctctggtacgcccagatccagccgcactggatcgcggcctccatcatcctggagttcttcctgatcgtcctcctgatccccgagcccgagaagcagcgcacgccccaggacaaccagctgacctacgtggtgatcgccatcctcaccgtcgtggccgccacgatggcgaacgagatgggcttcctggagaagaccaagaaggacctggggctcggcagcatcaccacccaggagagcgagtccaacatcctggacatcgacctgcggccggccagcgcctggacgctctacgccgtggccaccaccttcgtcacccccatgctgcgccactccatcgagaacagctccgtgaacgtgagcctgacggcgatcgccaaccaggccaccgtcctcatgggcctggggaagggctggcccctgtccaagatggacatcggggtgcccctcctggccatcggctgctacagccaggtgaacccgatcaccctgaccgcggccctcctgctgctcgtcgcccactacgccatcatcgggcccggcctgcaggccaaggcgacgcgggaggcccagaagcgcgccgccgccggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcggacgacctgggcgctgtgcgaggccctcaccctggccaccgggcccatctccacgctgtgggagggcaaccccgggcgcttctggaacaccaccatcgccgtcagcatggccaacatcttccggggctcctacctcgcgggcgccgggctgctgttcagcatcatgaagaacaccacgtccacccgccgcggcaccgggaacatcggcgagaccctcggcgagaagtggaagtcccggctgaacgccctggggaagtccgagttccagatctacaagaagtccggcatccaggaggtggaccgcacgctcgccaaggaggggatcaagcggggcgagaccgaccaccacgcggtgtcccgcgggagcgccaagctgcggtggttcgtcgagcgcaacatggtgaccccggagggcaaggtggtcgacctgggctgcgggcggggcgggtggtcctactactgcggcgggctcaagaacgtgcgcgaggtgaagggcctgaccaagggcgggcccggccacgaggagcccatccccatgagcacgtacgggtggaacctggtccggctccagagcggcgtggacgtgttcttcaccccgcccgagaagtgcgacaccctgctgtgcgacatcggggagtccagccccaaccccaccatcgaggccggccgcaccctccgggtcctgaacctggtggagaactggctcaacaacaacacgcagttctgcatcaaggtgctgaacccgtacatgccctccgtcatcgagaagatggaggccctgcagcgccagtacggcggggccctcgtgcggaaccccctgagccgcaactccacccacgagatgtactgggtgagcaacgcgaccggcaacatcgtctccagcgtgaacatgatctcccggatgctgatcaaccgcttcaccatgaagcacaagaaggccacgtacgagccggacgtggacctggggagcggcacccggaacatcgggatcgagtccgagatccccaacctcgacatcatcggcaagcgcatcgagaagatcaagcaggagcacgagatcagctggcactacgaccaggaccacccctacaagacctgggcctaccacggctcctacgagaccaagcagacggggagcgcctccagcatggtcaacggcgtggtgcggctgctgaccaagccctgggacgtcgtgccgatggtgacccagatggccatgaccgacacgacccccttcgggcagcagcgcgtcttcaaggagaaggtggacacccgcacccaggagcccaaggagggcacgaagaagctcatgaagatcaccgcggagtggctgtggaaggagctgggccggaagaagacgccccgcatgtgcacccgggaggagttcacgcgcaaggtgcggtccaacgccgccctcggggccatcttcaccgacgagaacaagtggaagtccgcccgcgaggcggtcgaggacggccggttctgggagctggtggaccgcgagcggaacctgcacctcgaggggaagtgcgagacctgcgtgtacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggagaacagcctctccggggtcgagggcgaggggctgcaccgcctgggctacatcctccgggacgtgggcaagaaggagggcggcgccatgtacgccgacgacaccgccgggtgggacacgcgcatcaccctggaggacctgaagaacgaggagatggtcaccaaccacatgaagggcgagcacaagaagctcgccgaggcgatcttcaagctgacctaccagaacaaggtggtgcgggtccagcgcccgacgccccgggggaccgtgatggacatcatcagccgccgggaccagcgcggctccggccaggtggggacctacggcctgaacaccttcacgaacatggaggcccagctcatccgccagatggagggggagggcatcttcaagagcatccagcacctgaccgccaccgaggagatcgccgtccagaactggctggcccgggtgggccgcgagcggctctcccgcatggcgatcagcggggacgactgcgtggtcaagcccatcgacgaccggttcgcctccgccctgaccgccctgaacgacatgggcaaggtgcgcaaggacatccagcagtgggagcccagccgggggtggaacgactggacccaggtgccgttctgctcccaccacttccacgagctcgtcatgaaggacggccgcgtgctggtggtcccctgccggaaccaggacgagctgatcgggcgcgcccggatcagccagggcgcgggctggtccctcaaggagaccgcctgcctgggcaagagctacgcccagatgtggaccctgatgtacttccaccgccgggacctccgcctggccgccaacgcgatctgctccgccgtgcccagccactgggtgcccacctcccggaccacgtggtacatccacgccaagcacgagtggatgaccaccgaggacatgctggccgtctggaaccgcgtgtggatccaggagaacccgtggatggaggacaagacccccgtggagagctgggaggaggtcccctacctcggcaagcgggaggaccagtggtgcgggtccctgatcggcctgacgagccgcgcgacctgggccaagaacatccagaccgccatcaaccaggtgcggagcctcatcgggaacgaggagtacaccgactacatgccctccatgaagcgcttccgccgggaggaggaggaggccggcgtgctgtggtga

SEQ ID NO: 9263 - RNA, 9873 nt, synthetic construct
  misc_feature 1..9873: note = derived and/or modified CDS sequence (opt1) from DENV-2__HQ705624__SS-prME
  source 1..9873: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgaagttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaaggtgcccttcgagatcaccgacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtgttcggcgcgatctacggcgccgccttcagcggggtctcctggacgatgaagatcctgatcggcgtgatcatcacctggatcgggatgaacagccgctccaccagcctgtccgtgagcctggtcctcgtgggcgtggtcaccctgtacctgggggccatggtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatcaagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtgttcaccaccaacatctggctcaagctgcgggacaagcaggacgtcttctgcgactccaagctgatgagcgccgccatcaaggacaaccgcgcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccggccgggctaccacacgcagaccgcggggccctggcacctcggcaagctggagatggacttcgacctgtgcgaggggaccaccgtggtcgtgacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtcaccgccgggcacggccagatcgacaacttctccctgggcgtgctggggatggccctcctgctggaggagatgctccgcacccggatcggcacgaagcacgcgatcctgctggtggccgtcagcttcgtgaccctcatcaccgggaacatgtccttccgcgacctgggccgcgtgatggtcatggtgggggccaccatgacggacgacatcggcatgggcgtgacctacctggccctcctggccgcgttcaaggtccggcccaccttcgccgccgggctgctcctgcgcaagctgaccagcaaggagctcatgatggccacgatcggcatcgccctgctgtcccagagcaccatccccgagaccatcctcgagctgaccgacgcgctggccctcgggatgatggtgctgaagatcgtgcggaacatggagaagtaccagctggccgtcacggtgatggccatctcctgcgtgccgaacgccgtcatcctccagaacgcgtggaaggtgagctgcaccatcctggccgccgtctccgtgagccccctgctcctgacctccagccagcagaaggccgactggatccccctggcgctcaccatcaagggcctgaaccccacggccatcttcctgaccaccctctcccgcaccagcaagaagcggtcctggccgctgaacgaggccatcatggccgtgggcatggtcagcatcctggcctccagcctcctgaagaacgacatccccatgacggggcccctggtggcgggcgggctcctgaccgtgtgctacgtcctgaccggccgcagcgccgacctcgagctggagcgggccgccgacgtgaagtgggaggaccaggccgagatctccgggagctcccccatcctgagcatcaccatctccgaggacggcagcatgtccatcaagaacgaggaggaggagcagacgctcaccatcctgatccgcaccggcctgctcgtgatcagcggggtcttcccggtgtccatccccatcaccgcggccgcctggtacctgtgggaggtgaagaagcagcgggccggcgtcctgtgggacgtgcccagcccgccgcccgtggagaaggccgagctcgaggacggggcgtaccgcatcaagcagcggggcatcctggggtactcccagatcggcgccggcgtctacaaggaggggaccttccacacgatgtggcacgtgacccgcggcgccgtgctgatgcaccgggggaagcgcatcgagcccagctgggccgacgtcaagaaggacctcatctcctacggcgggggctggaagctggagggcgagtggaaggagggggaggaggtccaggtgctggccctcgagcccggcaagaacccccgggcggtccagaccaagcccgggatcttcaagaccaacacgggcaccatcggggccgtgagcctggacttccccggcacctccggcagccccatcgtggaccgcaaggggaaggtcgtgggcctgtacgggaacggcgtggtcacccggtccggcgcctacgtgagcgccatcgcgcagacggagaagtccatcgaggacaaccccgagatcgaggacgacatcttccgcaagaagcggctcaccatcatggacctgcaccccggggccggcaagaccaagcgctacctgcccgccatcgtgcgggaggccatcaagcgcgggctgcgcaccctcatcctggccccgacgcgggtcgtggcggccgagatggaggaggccctgcgcggcctccccatccggtaccagaccaccgccatcaagaccgagcacacggggcgcgagatcgtggacctgatgtgccacgccaccttcaccatgcggctgctcagccccgtccgcgtgcccaactacaacctgatcatcatggacgaggcgcacttcaccgacccggccagcatcgccgcccggggctacatctccacgcgcgtggagatgggcgaggccgcggggatcttcatgaccgccacgccgcccggcagccgggaccccttcccgcagtccaacgcccccatcatggacgaggagcgcgagatccccgagcggagctggaactccgggcacgagtgggtcaccgacttcaagggcaagacggtgtggttcgtgcccagcatcaaggccgggaacgacatcgcggcctgcctgcgcaagaacggcaagaaggtcatccagctctcccggaagaccttcgacagcgagtacgtgaagacccgcgccaacgactgggacttcgtggtcaccacggacatctccgagatgggcgccaacttcaaggccgagcgggtgatcgacccgcgccggtgcatgaagcccgtgatcctgaccgacggggaggagcgcgtcatcctggcgggccccatgcccgtgacccacagctccgccgcccagcggcgcgggcgcatcggccggaacccgaagaacgagaacgaccagtacatctacatgggggagcccctcgagaacgacgaggactgcgcccactggaaggaggccaagatgctgctggacaacatcaacacccccgagggcatcatccccagcatgttcgagccggagcgcgagaaggtggacgcgatcgacggcgagtaccggctccgcggggaggcccggaagacgttcgtcgacctgatgcgccggggcgacctgcccgtgtggctcgcctacaaggtggccgccgaggggatcaactacgcggaccgcaagtggtgcttcgacggcatcaagaacaaccagatcctggaggagaacatggaggtcgagatctggaccaaggagggggagcggaagaagctgaagccccgctggctcgacgcccggatctactccgacccgctggccctgaaggagttcaaggagttcgccgcgggccgcaagagcctcaccctgaacctgatcaccgagatgggccggctccccacgttcatgacccagaaggcccgcaacgccctggacaacctggccgtgctccacaccgccgaggccgggggccgggcctacaaccacgccctgtccgagctgcccgagaccctcgagacgctgctgctcctgaccctgctcgccaccgtcaccgggggcatcttcctgttcctgatgagcggcaaggggatcggcaagatgaccctcgggatgtgctgcatcatcacggcctccatcctgctgtggtacgcgcagatccagccccactggatcgccgccagcatcatcctcgagttcttcctgatcgtgctgctcatcccggagcccgagaagcagcgcacgccccaggacaaccagctgacctacgtggtcatcgccatcctgaccgtggtggccgcgacgatggccaacgagatgggcttcctcgagaagaccaagaaggacctggggctgggctccatcaccacccaggagagcgagagcaacatcctcgacatcgacctgcggcccgcctccgcctggacgctgtacgccgtcgcgaccaccttcgtgaccccgatgctccgccacagcatcgagaactccagcgtgaacgtctccctgacggccatcgccaaccaggccaccgtgctgatgggcctcgggaagggctggcccctgagcaagatggacatcggggtgcccctgctcgcgatcggctgctactcccaggtcaaccccatcaccctgaccgccgccctgctcctgctggtggcccactacgccatcatcgggccgggcctccaggcgaaggccacgcgggaggcccagaagcgcgccgccgcgggcatcatgaagaaccccaccgtggacgggatcaccgtcatcgacctggagcccatcccctacgacccgaagttcgagaagcagctgggccaggtgatgctcctgatcctgtgcgtgacccaggtcctcatgatgcggacgacctgggccctgtgcgaggccctgaccctcgccaccgggcccatcagcacgctgtgggagggcaaccccgggcgcttctggaacaccaccatcgccgtgtccatggcgaacatcttccgcggcagctacctggccggcgccgggctcctgttctccatcatgaagaacaccacgaacacccggcgcggcaccgggaacatcggcgagaccctgggcgagaagtggaagtcccggctcaacgccctggggaagtccgagttccagatctacaagaagtccggcatccaggaggtggaccgcacgctggcgaaggaggggatcaagcggggcgagaccgaccaccacgccgtctcccgcgggagcgccaagctccggtggttcgtggagcgcaacatggtgacccccgagggcaaggtcgtggacctgggctgcgggcggggcgggtggtcctactactgcggcgggctgaagaacgtgcgcgaggtcaagggcctcaccaagggcgggccgggccacgaggagcccatccccatgagcacgtacgggtggaacctggtgcggctgcagtccggcgtggacgtcttcttcacgccgcccgagaagtgcgacaccctcctgtgcgacatcggggagagcagccccaaccccaccatcgaggccggccgcaccctgcgggtgctcaacctggtggagaactggctgaacaacaacacgcagttctgcatcaaggtcctcaacccctacatgccctccgtgatcgagaagatggaggccctgcagcgcaagtacggcggggcgctggtgcggaaccccctgagccgcaactccacccacgagatgtactgggtcagcaacgccaccggcaacatcgtgtccagcgtgaacatgatctcccggatgctcatcaaccgcttcaccatgaagcacaagaaggccacgtacgagcccgacgtcgacctggggagcggcacccggaacatcgggatcgagtccgagatcccgaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtggtccgcctcctgaccaagccctgggacgtggtgcccatggtcacccagatggcgatgacggacaccaccccgttcgggcagcagcgggtgttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcacccggaaggtccgctccaacgccgccctgggggccatcttcaccgacgagaacaagtggaagtccgcgcgggaggccgtggaggacggccgcttctgggagctcgtggaccgggagcgcaacctgcacctggaggggaagtgcgagacctgcgtctacaacatgatgggcaagcgggagaagaagctcggggagttcggcaaggccaagggctcccgcgccatctggtacatgtggctgggggcgcggttcctggagttcgaggccctcggcttcctgaacgaggaccactggttcagccgcgggaactccctgagcggcgtggagggggagggcctccaccggctgggctacatcctgcgcgacgtcgggaagaaggagggcggggccatgtacgccgacgacacggccggctgggacacccggatcaccctcgaggacctgaagaacgaggagatggtgaccaaccacatgaagggggagcacaagaagctggcggaggccatcttcaagctcacgtaccagaacaaggtggtccgcgtgcagcggcccaccccgcgcggcaccgtgatggacatcatcagccggcgcgaccagcgcggctccgggcaggtcggcacctacgggctgaacacgttcaccaacatggaggcccagctgatccggcagatggagggcgagggcatcttcaagagcatccagcacctcaccgccaccgaggagatcgccgtgcagaactggctggcgcgcgtggggcgggagcgcctgtcccggatggccatcagcggcgacgactgcgtcgtgaagcccatcgacgaccgcttcgcctccgccctcacggccctgaacgacatggggaaggtgcggaaggacatccagcagtgggagcccagccgcggctggaacgactggacccaggtccccttctgctcccaccacttccacgagctggtgatgaaggacgggcgggtgctcgtcgtgccgtgccgcaaccaggacgagctgatcggccgggcgcgcatcagccagggcgccgggtggtccctgaaggagaccgcctgcctcggcaagagctacgcccagatgtggaccctgatgtacttccaccggcgcgacctgcggctcgccgcgaacgccatctgctccgccgtgcccagccactgggtccccacctcccgcacgacctggagcatccacgccaagcacgagtggatgaccaccgaggacatgctggcggtgtggaaccgggtgtggatccaggagaacccctggatggaggacaagacgccggtcgagtcctgggaggaggtgccctacctggggaagcgcgaggaccagtggtgcggcagcctcatcgggctgacctcccgggccacctgggccaagaacatccagaccgccatcaaccaggtgcgcagcctgatcggcaacgaggagtacacggactacatgcccagcatgaagcgcttccggcgcgaggaggaggaggccggcgtcctctggtga

SEQ ID NO: 9264 - RNA, 9876 nt, synthetic construct
  misc_feature 1..9876: note = derived and/or modified CDS sequence (opt1) from DENV-2__HQ705625__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatgaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcacgaagaacaaccagatcctggaggagaacatggaggtggagatctggaccaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccacgttcatgacccagaaggcccggaacgccctggacaacctcgccgtcctgcacaccgccgaggccgggggccgcgcctacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgacgatggccaacgagatgggcttcctggagaagaccaagaaggacctggggctcggcagcatcaccacccaggagagcgagtccaacatcctggacatcgacctgcgcccggccagcgcctggacgctctacgccgtggcgaccaccttcgtcacccccatgctgcggcactccatcgagaacagctccgtgaacgtgagcctgacggccatcgccaaccaggccaccgtcctcatgggcctggggaagggctggcccctgtccaagatggacatcggggtgcccctcctggcgatcggctgctacagccaggtgaacccgatcaccctgaccgccgccctcctgctgctcgtcgcccactacgccatcatcgggcccggcctgcaggcgaaggccacgcgcgaggcccagaagcgggccgccgcgggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcgcacgacctgggccctgtgcgaggccctcaccctggccaccgggcccatctccacgctgtgggagggcaaccccgggcggttctggaacaccaccatcgccgtcagcatggcgaacatcttccgcggctcctacctcgccggcgccgggctgctgttcagcatcatgaagaacaccacgtccacccgccggggcaccgggaacatcggcgagaccctcggcgagaagtggaagtcccgcctgaacgccctggggaagtccgagttccagatctacaagaagtccggcatccaggaggtggaccggacgctcgcgaaggaggggatcaagcgcggcgagaccgaccaccacgccgtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacgtacgggtggaacctggtccgcctccagagcggcgtggacgtgttcttcaccccgcccgagaagtgcgacaccctgctgtgcgacatcggggagtccagccccaaccccaccatcgaggccggccggaccctccgcgtcctgaacctggtggagaactggctcaacaacaacacgcagttctgcatcaaggtgctgaacccgtacatgccctccgtcatcgagaagatggaggccctgcagcggcagtacggcggggcgctcgtgcgcaaccccctgagccggaactccacccacgagatgtactgggtgagcaacgccaccggcaacatcgtctccagcgtgaacatgatctcccgcatgctgatcaaccggttcaccatgaagcacaagaaggccacgtacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagacggggagcgcctccagcatggtcaacggcgtggtgcgcctgctgaccaagccctgggacgtcgtgccgatggtgacccagatggcgatgaccgacacgacccccttcgggcagcagcgcgtcttcaaggagaaggtggacacccggacccaggagcccaaggagggcacgaagaagctcatgaagatcaccgccgagtggctgtggaaggagctgggcaagaagaagacgccccgcatgtgcacccgggaggagttcacgaagaaggtgcgctccaacgccgccctcggggccatcttcaccgacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacgcggatcaccctggaggacctgaagaacgaggagatggtcaccaaccacatgaagggggagcacaagaagctcgcggaggccatcttcaagctgacctaccagaacaaggtggtgcgcgtccagcggccgacgccccgcggcaccgtgatggacatcatcagccggcgcgaccagcggggctccgggcaggtcggcacctacgggctgaacaccttcacgaacatggaggcccagctcatccgccagatggagggcgagggcatcttcaagagcatccagcacctgaccgccaccgaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagaccgcctgcctgggcaagagctacgcccagatgtggaccctgatgtacttccaccggcgcgacctccggctggccgcgaacgccatctgctccgccgtgcccagccactgggtgcccacctcccgcaccacgtggagcatccacgccaagcacgagtggatgaccaccgaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgacgagccgggccacctgggccaagaacatccagaccgccatcaaccaggtgcgctccctcatcggcaacgaggagtacaccgactacatgcccagcatgaagcggttccgccgcgaggaggaggaggccggcgtgctgtggtga

SEQ ID NO: 9265 - RNA, 9876 nt, synthetic construct
  misc_feature 1..9876: note = derived and/or modified CDS sequence (opt1) from DENV-2__JF730052__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatgaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgaccaccgggaacatgtccttccgggacctgggccgcgtgatggtcatggtgggggccacgatgaccgacgacatcggcatgggcgtgacctacctcgccctgctggccgcgttcaaggtccgccccaccttcgccgccgggctcctgctgcggaagctcacgagcaaggagctgatgatggccaccatcggcatcgccctgctctcccagagcaccatccccgagaccatcctggagctgacggacgcgctcgccctggggatgatggtgctgaagatcgtgcgcaacatggagaagtaccagctcgccgtcaccatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgacgatcaagggcctgaaccccaccgccatcttcctcaccaccctgtcccggacgagcaagaagcgctcctggccgctgaacgaggccatcatggccgtgggcatggtgagcatcctcgcctccagcctgctgaagaacgacatccccatgaccgggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcacgatctccgaggacggcagcatgtccatcaagaacgaggaggaggagcagaccctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggacgttccacaccatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagacgaacaccggcaccatcggggccgtcagcctggacttctcccccggcaccagcggctcccccatcgtggaccggaaggggaaggtggtcggcctctacgggaacggcgtggtgacgcgcagcggcgcctacgtctccgccatcgcgcagaccgagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcacgctgatcctggccccgacccgcgtggtcgcggccgagatggaggaggccctccggggcctgcccatccgctaccagacccccgccatcaagaccgagcacacggggcgggagatcgtggacctgatgtgccacgccaccttcaccatgcgcctcctgagccccgtgcgggtcccgaactacaacctgatcatcatggacgaggcgcacttcaccgaccccgcctccatcgccgcccgcggctacatcagcacgcgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagacggtctggttcgtgccgtccatcaaggccgggaacgacatcgcggcctgcctccggaagaacggcaagaaggtgatccagctgagccgcaagaccttcgactccgagtacgtcaagacccgggccaacgactgggacttcgtggtgaccacggacatcagcgagatgggcgccaacttcaaggccgagcgcgtcatcgacccccggcgctgcatgaagcccgtgatcctgaccgacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagacgttcgtggacctgatgcggcgcggcgacctccccgtctggctggcctacaaggtggccgccgaggggatcaactacgcggaccggaagtggtgcttcgacggcaccaagaacaaccagatcctggaggagaacatggaggtggagatctggaccaaggagggggagcgcaagaagctcaagccgcggtggctggacgcccgcatctacagcgaccccctggccctcaaggagttcaaggagttcgccgcgggccggaagtccctgaccctgaacctcatcacggagatgggccgcctgcccaccttcatgacccagaaggcccggaacgccctggacaacctcgccgtcctgcacaccgccgaggccgggggccgcgcctacaaccacgccctgagcgagctccccgagacgctggagaccctgctcctgctgaccctcctggccaccgtgaccgggggcatcttcctgttcctcatgtccggcaaggggatcggcaagatgacgctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcacggtcgtggccgcgaccatggccaacgagatgggcttcctggagaagaccaagaaggacctggggctcggcagcatcaccacgcaggagagcgagtccaacatcctggacatcgacctgcgcccggccagcgcctggaccctctacgccgtggcgaccaccttcgtcacgcccatgctgcggcactccatcgagaacagctccgtgaacgtgagcctgaccgccatcgccaaccaggccaccgtcctcatgggcctggggaagggctggcccctgtccaagatggacatcggggtgcccctcctggcgatcggctgctacagccaggtgaacccgatcaccctgacggccgccctcctgctgctcgtcgcccactacgccatcatcgggcccggcctgcaggcgaaggccacccgcgaggcccagaagcgggccgccgcgggcatcatgaagaaccccaccgtggacgggatcaccgtgatcgacctggagcccatcccgtacgaccccaagttcgagaagcagctcggccaggtcatgctgctgatcctctgcgtgacccaggtcctgatgatgcgcaccacctgggccctgtgcgaggccctcaccctggccacggggcccatctccaccctgtgggagggcaaccccgggcggttctggaacaccaccatcgccgtcagcatggcgaacatcttccgcggctcctacctcgccggcgccgggctgctgttcagcatcatgaagaacacgacctccacccgccggggcaccgggaacatcggcgagacgctcggcgagaagtggaagtcccgcctgaacgccctggggaagtccgagttccagatctacaagaagtccggcatccaggaggtggaccggaccctcgcgaaggaggggatcaagcgcggcgagaccgaccaccacgccgtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgacgaagggcgggcccggccacgaggagcccatccccatgagcacctacgggtggaacctggtccgcctccagagcggcgtggacgtgttcttcaccccgcccgagaagtgcgacaccctgctgtgcgacatcggggagtccagccccaaccccaccatcgaggccggccggacgctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacccacgagatgtactgggtgagcaacgccaccggcaacatcgtctccagcgtgaacatgatctcccgcatgctgatcaaccggttcacgatgaagcacaagaaggccacctacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagacgaagcagaccgggagcgcctccagcatggtcaacggcgtggtgcgcctgctgaccaagccctgggacgtcgtgccgatggtgacccagatggcgatgacggacaccacccccttcgggcagcagcgcgtcttcaaggagaaggtggacacccggacgcaggagcccaaggagggcaccaagaagctcatgaagatcaccgccgagtggctgtggaaggagctgggcaagaagaagacgccccgcatgtgcacgcgggaggagttcaccaagaaggtgcgctccaacgccgccctcggggccatcttcaccgacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacacggccggctgggacacccggatcaccctggaggacctgaagaacgaggagatggtcaccaaccacatgaagggggagcacaagaagctcgcggaggccatcttcaagctgacgtaccagaacaaggtggtgcgcgtccagcggccgacgccccgcggcaccgtgatggacatcatcagccggcgcgaccagcggggctccggccaggtgggcacctacgggctgaacacgttcaccaacatggaggcccagctcatccgccagatggagggcgagggcatcttcaagagcatccagcacctgaccgccaccgaggagatcgccgtccagaactggctggcgcgcgtggggcgggagcgcctctcccggatggccatcagcggcgacgactgcgtggtcaagcccatcgacgaccgcttcgcctccgccctgacggccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagaccgcctgcctgggcaagagctacgcccagatgtggaccctgatgtacttccaccggcgcgacctccggctggccgcgaacgccatctgctccgccgtgcccagccactgggtgcccacctcccgcacgacctggagcatccacgccaagcacgagtggatgaccaccgaggacatgctggcggtctggaaccgggtgtggatccaggagaacccgtggatggaggacaagacgcccgtggagtcctgggaggaggtcccctacctcgggaagcgcgaggaccagtggtgcggcagcctgatcgggctgaccagccgggccacctgggccaagaacatccagaccgccatcaaccaggtgcgctccctcatcggcaacgaggagtacacggactacatgcccagcatgaagcggttccgccgcgaggaggaggaggccggcgtgctgtggtga

SEQ ID NO: 9266 - RNA, 9876 nt, synthetic construct
  misc_feature 1..9876: note = derived and/or modified CDS sequence (opt1) from DENV-2__EU482748__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggagaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtcctcaagatcgtgcgcaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgccatcgcgcagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcaccctgatcctcgccccgacgcgcgtggtggcggccgagatggaggaggccctgcggggcctgcccatccgctaccagacccccgccatcaagaccgagcacaccgggcgggagatcgtcgacctcatgtgccacgccacgttcaccatgcgcctgctgagccccgtgcgggtgccgaactacaacctcatcatcatggacgaggcgcacttcaccgaccccgcctccatcgccgcccgcggctacatcagcacccgggtcgagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggccgagcgcgtgatcgacccccggcgctgcatgaagcccgtcatcctcacggacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagaccttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtgctgcacaccgccgaggccgggggccgcgcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccgcccggccagcgcctggaccctgtacgccgtggcgacgaccttcgtgacccccatgctgcggcactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgccgtgagcatggcgaacatcttccgcggctcctacctggccggcgccgggctcctgttcagcatcatgaagaacaccacctccacgcgccggggcaccgggaacatcggcgagaccctgggcgagaagtggaagtcccgcctgaacgccctcgggaagtccgagttccagatctacaagaagtccggcatccaggaggtcgaccggaccctggcgaaggaggggatcaagcgcggcgagacggaccaccacgccgtgtcccgggggagcgccaagctgcgctggttcgtggagcggaacatggtcaccccggagggcaaggtggtggacctcggctgcgggcgcggcgggtggtcctactactgcggcgggctgaagaacgtccgggaggtgaagggcctgaccaagggcgggcccggccacgaggagcccatccccatgagcacctacgggtggaacctcgtgcgcctgcagagcggcgtcgacgtgttcttcacgccgcccgagaagtgcgacaccctgctctgcgacatcggggagtccagccccaaccccaccatcgaggccggccggaccctgcgcgtgctgaacctcgtcgagaactggctgaacaacaacacccagttctgcatcaaggtgctgaacccgtacatgccctccgtgatcgagaagatggaggccctccagcggaagtacggcggggcgctggtccgcaaccccctgagccggaactccacgcacgagatgtactgggtgagcaacgccaccggcaacatcgtgtccagcgtcaacatgatctcccgcatgctgatcaaccggttcaccatgaagcacaagaagaccacgtacgagccggacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccctgggacgtggtcccgatggtgacccagatggccatgacggacaccacccccttcgggcagcagcgcgtgttcaaggagaaggtcgacacccggacgcaggagcccaaggagggcaccaagaagctgatgaagatcaccgcggagtggctgtggaaggagctcggcaagaagaagacgccccgcatgtgcacgcgggaggagttcacccgcaaggtgcggtccaacgccgccctgggggccatcttcaccgacgagaacaagtggaagtccgcccgcgaggcggtggaggacggccggttctgggagctggtcgaccgcgagcggaacctccacctggaggggaagtgcgagacctgcgtgtacaacatgatgggcaagcgcgagaagaagctgggggagttcggcaaggccaagggctcccgggccatctggtacatgtggctcggggcccgcttcctggagttcgaggcgctgggcttcctcaacgaggaccactggttcagccgggggaacagcctgtccggcgtggagggggagggcctgcaccgcctcggctacatcctgcgggacgtcagcaagaaggagggcggcgccatgtacgccgacgacacggccgggtgggacacccgcatcaccctggaggacctcaagaacgaggagatggtgaccaaccacatgaagggcgagcacaagaagctggccgaggcgatcttcaagctgacgtaccagaacaaggtcgtgcgggtgcagcgcccgacgccccgggggaccgtcatggacatcatctcccgccgggaccagcgcggcagcggccaggtggggacctacggcctcaacacgttcaccaacatggaggcccagctgatccgccagatggagggggagggcatcttcaagtccatccagcacctgaccgccaccgaggagatcgtggtccagaactggctcgcccgggtgggccgcgagcggctgagccgcatggccatctccggggacgactgcgtggtcaagcccatcgacgaccggttcgcgagcgccctgacggccctcaacgacatgggcaaggtgcgcaaggacatccagcagtgggagccctcccgggggtggaacgactggacccaggtgccgttctgcagccaccacttccacgagctggtcatgaaggacggccgcgtgctggtggtcccctgccggaaccaggacgagctcatcgggcgcgcccggatctcccagggcgccggctggagcctgaaggagaccgcgtgcctggggaagtcctacgcccagatgtggaccctcatgtacttccaccgccgggacctgcgcctggccgccaacgccatctgcagcgcggtgccctcccactgggtgcccaccagccggacgacctggtccatccacgccaagcacgagtggatgaccaccgaggacatgctcgccgtctggaaccgcgtgtggatccaggagaacccgtggatggaggacaagacgcccgtggagagctgggaggaggtcccctacctgggcaagcgggaggaccagtggtgcgggagcctgatcggcctcacctcccgcgccacctgggcgaagaacatccagaccgccatcaaccaggtgcggagcctgatcgggaacgaggagtacacggactacatgccctccatgaagcgcttccgccgggaggaggaggaggccggcgtgctgtggtga

SEQ ID NO: 9267 - RNA, 9876 nt, synthetic construct
  misc_feature 1..9876: note = derived and/or modified CDS sequence (opt1) from DENV-2__EU482749__SS-prME
  source 1..9876: mol_type = other RNA
accgcgggcgtgatcgtcatgctgatccccaccgccatggcgttccacctcaccacccggaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagaccatcgagacctggatcctgcggcacccgggcttcaccatcatggccgcgatcctggcctacaccatcgggacgacccacttccagcgcgccctcatcttcatcctgctgaccgccgtggcgcccagcatgaccatgcggtgcatcggcatcagcaaccgcgacttcgtcgagggcgtgagcgggggctcctgggtggacatcgtcctcgagcacgggagctgcgtgacgaccatggccaagaacaagcccaccctggacttcgagctgatcaagaccgaggccaagcagcccgccacgctccggaagtactgcatcgaggccaagctgaccaacaccaccacggagtcccgctgcccgacccagggcgagcccagcctgtccgaggagcaggacaagcggttcatctgcaagcacagcatggtggaccgcggctgggggaacggctgcgggctgttcggcaagggcgggatcgtgacctgcgcgatgttcacgtgcaagaagaacatggagggcaaggtggtgcagcccgagaacctggagtacacgatcgtcatcacgccccactccggggaggagcacgccgtgggcaacgacaccgggaagcacggcaaggagatcaagatcaccccgcagagctccatcaccgaggccgagctgacggggtacggcaccgtgaccatggagtgcagcccccggaccggcctcgacttcaacgagatggtcctgctgcagatggaggacaaggcctggctcgtgcaccgccagtggttcctggacctgcccctcccctggctgccgggggccgacacgcagggctccaactggatccagaaggagaccctggtgaccttcaagaacccccacgcgaagaagcaggacgtcgtggtcctcgggagccaggagggcgccatgcacaccgccctgacgggggccaccgagatccagatgagctccggcaacctcctgttcaccggccacctgaagtgccggctgcgcatggacaagctccagctgaaggggatgagctactccatgtgcaccggcaagttcaagatcgtgaaggagatcgccgagacgcagcacgggaccatcgtgatccgggtccagtacgagggcgacggcagcccctgcaagatccccttcgagatcaccgacctggagaagcgccacgtgctcgggcggctgatcaccgtgaacccgatcgtcacggagaaggactcccccgtgaacatcgaggcggagccgcccttcggcgacagctacatcatcatcggggtggagccgggccagctgaagctcaactggttcaagaaggggtccagcatcggccagatgttcgagaccaccatgcgcggcgccaagcgcatggccatcctgggggacaccgcctgggacttcggctccctcgggggcgtcttcacgagcatcgggaaggccctccaccaggtgttcggcgcgatctacggcgccgccttctccggggtgagctggaccatgaagatcctgatcggcgtcatcatcacctggatcgggatgaactcccggagcacctccctgagcgtgtccctggtgctcgtcggcgtggtgacgctgtacctgggggccatggtccaggcggacagcggctgcgtggtgtcctggaagaacaaggagctcaagtgcggcagcgggatcttcatcaccgacaacgtccacacctggaccgagcagtacaagttccagcccgagagcccctccaagctggccagcgccatccagaaggcccacgaggagggcatctgcgggatccgctccgtgacgcggctggagaacctcatgtggaagcagatcacccccgagctgaaccacatcctgagcgagaacgaggtgaagctcaccatcatgaccggcgacatccgcgggatcatgcaggccggcaagcggtccctgcgcccgcagcccacggagctgaagtacagctggaagacctggggcaaggcgaagatgctctccaccgagagccacaaccagaccttcctgatcgacgggcccgagacggccgagtgcccgaacaccaaccgggcctggaactccctggaggtcgaggactacggcttcggggtgttcaccaccaacatctggctcaagctgcgcgagaagcaggacgtgttctgcgacagcaagctgatgtccgccgccatcaaggacaaccgggcggtccacgccgacatgggctactggatcgagagcgccctcaacgacacctggaagatggagaaggcctccttcatcgaggtcaagagctgccactggcccaagtcccacacgctgtggagcaacggcgtgctggagtccgagatgatcatccccaagaacttcgccgggcccgtgagccagcacaactaccgcccgggctaccacacccagaccgcggggccctggcacctcggcaagctggagatggacttcgacctgtgcgaggggaccacggtggtggtcaccgaggactgcggcaaccggggccccagcctccgcaccaccacggcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacgcgcatcggcaccaagcacgcgatcctcctggtggccgtgtccttcgtcaccctgatcaccgggaacatgagcttccgggacctcggccgcgtgatggtgatggtcggggccacgatgaccgacgacatcggcatgggcgtgacctacctggccctgctcgccgcgttcaaggtgcgccccaccttcgccgccgggctgctgctccggaagctgacgtccaaggagctgatgatggccaccatcggcatcgccctcctgagccagtccaccatccccgagaccatcctggagctcacggacgcgctggccctggggatgatggtcctcaagatcgtgcgcaacatggagaagtaccagctggccgtgaccatcatggccatcagctgcgtcccgaacgccgtgatcctgcagaacgcgtggaaggtgtcctgcaccatcctcgccgccgtcagcgtgagccccctgctgctcaccagctcccagcagaaggccgactggatccccctggcgctgacgatcaagggcctcaaccccaccgccatcttcctgaccaccctgagccggacgtccaagaagcgcagctggccgctcaacgaggccatcatggccgtcggcatggtgtccatcctggccagcagcctgctcaagaacgacatccccatgaccgggcccctggtggcgggcgggctgctcaccgtctgctacgtgctgaccggccggtccgccgacctggagctcgagcgcgccgccgacgtgaagtgggaggaccaggccgagatcagcgggtccagccccatcctgtccatcacgatcagcgaggacggctccatgagcatcaagaacgaggaggaggagcagaccctgaccatcctcatccggaccggcctgctggtcatctccggggtgttcccggtgagcatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtacagccagatcggcgccggcgtgtacaaggaggggacgttccacaccatgtggcacgtgacccggggcgccgtcctgatgcaccgcgggaagcggatcgagccctcctgggccgacgtgaagaaggacctgatcagctacggcgggggctggaagctcgagggcgagtggaaggagggggaggaggtgcaggtcctggccctggagcccggcaagaacccccgcgcggtgcagaccaagcccgggatcttcaagacgaacaccggcaccatcggggccgtgtccctcgacttcagccccggcacctccggcagccccatcgtcgaccggaaggggaaggtggtgggcctgtacgggaacggcgtcgtgacgcgctccggcgcctacgtgagcgccatcgcgcagaccgagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcacgctgatcctcgccccgacccgcgtggtggcggccgagatggaggaggccctgcggggcctgcccatccgctaccagaccaccgccatcaagacggagcacaccgggcgggagatcgtcgacctcatgtgccacgccaccttcaccatgcgcctgctgtcccccgtgcgggtgcccaactacaacctcatcatcatggacgaggcgcacttcacggacccggccagcatcgccgcccgcggctacatctccacccgggtcgagatgggcgaggccgcggggatcttcatgaccgccacgccgcccggcagccgcgaccccttcccgcagtccaacgcccccatcatggacgaggagcgggagatccccgagcgcagctggaactccgggcacgagtgggtgacggacttcaagggcaagaccgtgtggttcgtccccagcatcaaggccgggaacgacatcgcggcctgcctgcggaagaacggcaagaaggtgatccagctgtcccgcaagaccttcgacagcgagtacgtgaagacccgggccaacgactgggacttcgtcgtgacgaccgacatctccgagatgggcgccaacttcaaggccgagcgcgtgatcgacccgcggcgctgcatgaagcccgtcatcctcaccgacggggaggagcgggtgatcctggcgggccccatgcccgtgacccacagctccgccgcccagcgccgggggcgcatcggccgcaacccgaagaacgagaacgaccagtacatctacatgggggagcccctggagaacgacgaggactgcgcccactggaaggaggccaagatgctcctggacaacatcaacacgcccgagggcatcatccccagcatgttcgagccggagcgggagaaggtcgacgcgatcgacggcgagtaccgcctgcgcggggaggcccgcaagaccttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggaccaaggagggggagcgcaagaagctgaagccccggtggctggacgcccgcatctactccgacccgctcgccctgaaggagttcaaggagttcgccgcgggccgcaagagcctgaccctcaacctgatcacggagatgggccgcctgcccaccttcatgacccagaaggcccggaacgccctcgacaacctggccgtgctgcacaccgccgaggccgggggccgcgcctacaaccacgccctctccgagctgcccgagacgctggagaccctcctgctgctcaccctgctggccaccgtcaccgggggcatcttcctcttcctgatgagcggcaaggggatcggcaagatgacgctggggatgtgctgcatcatcaccgcctccatcctcctgtggtacgcgcagatccagccccactggatcgccgccagcatcatcctggagttcttcctcatcgtgctgctgatcccggagcccgagaagcagcggacgccccaggacaaccagctcacctacgtcgtgatcgccatcctgacggtggtcgccgcgaccatggccaacgagatgggcttcctggagaagaccaagaaggacctcgggctgggcagcatcaccacgcaggagtccgagagcaacatcctggacatcgacctccgccccgcctccgcctggaccctgtacgccgtggcgaccaccttcgtgacgccgatgctgcggcacagcatcgagaactccagcgtcaacgtgtccctcaccgccatcgccaaccaggccaccgtgctgatgggcctggggaagggctggcccctcagcaagatggacatcggggtccccctgctggcgatcggctgctactcccaggtgaaccccatcaccctcacggccgccctgctgctcctggtggcccactacgccatcatcgggccgggcctgcaggcgaaggccacccgcgaggcccagaagcgggccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtcctgatgatgcgcaccacctgggccctctgcgaggccctgaccctggccacggggcccatcagcaccctctgggagggcaaccccgggcggttctggaacaccaccatcgccgtgtccatggcgaacatcttccgcggcagctacctggccggcgccgggctcctgttctccatcatgaagaacacgaccaacacccgccggggcaccgggaacatcggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgtcccgggggagcgccaagctgcgctggttcgtggagcggaacatggtcacccccgagggcaaggtggtggacctcggctgcgggcgcggcgggtggtcctactactgcggcgggctgaagaacgtccgggaggtgaagggcctgacgaagggcgggccgggccacgaggagcccatccccatgagcacctacgggtggaacctcgtgcgcctgcagagcggcgtcgacgtgttcttcacgccgcccgagaagtgcgacaccctgctctgcgacatcggggagtccagccccaaccccaccatcgaggccggccggacgctgcgcgtgctgaacctcgtcgagaactggctgaacaacaacacccagttctgcatcaaggtgctgaacccctacatgccctccgtgatcgagaagatggaggccctccagcggaagtacggcggggcgctggtccgcaaccccctgagccggaactccacccacgagatgtactgggtgagcaacgccaccggcaacatcgtgtccagcgtcaacatgatctcccgcatgctgatcaaccggttcacgatgaagcacaagaaggccacctacgagcccgacgtggacctcgggagcggcacccgcaacatcgggatcgagtccgagatcccgaacctggacatcatcggcaagcggatcgagaagatcaagcaggagcacgagaccagctggcactacgaccaggaccacccctacaagacgtgggcctaccacggctcctacgagaccaagcagaccgggagcgcctccagcatggtgaacggcgtcgtgcgcctgctcaccaagccctgggacgtggtccccatggtgacgcagatggcgatgaccgacaccaccccgttcgggcagcagcgcgtgttcaaggagaaggtcgacacgcggacccaggagcccaaggagggcaccaagaagctgatgaagatcaccgccgagtggctgtggaaggagctcggcaagaagaagacgccccgcatgtgcacccgggaggagttcacccgcaaggtgcggtccaacgccgccctgggggccatcttcaccgacgagaacaagtggaagtccgcgcgcgaggccgtggaggacggccggttctgggagctggtcgaccgcgagcggaacctccacctggaggggaagtgcgagacgtgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtggagggggagggcctgcaccgcctcggctacatcctgcgggacgtcgggaagaaggagggcggggccatgtacgccgacgacaccgccggctgggacacccgcatcaccctggaggacctcaagaacgaggagatggtgacgaaccacatgaagggggagcacaagaagctggcggaggccatcttcaagctgacctaccagaacaaggtcgtgcgggtgcagcgccccaccccgcggggcaccgtcatggacatcatcagccgccgggaccagcgcggctccggccaggtgggcacgtacgggctcaacaccttcaccaacatggaggcccagctgatccgccagatggagggcgagggcatcttcaagagcatccagcacctgaccgccacggaggagatcgccgtgcagaactggctcgcgcgggtcgggcgcgagcggctgtcccgcatggccatcagcggcgacgactgcgtggtgaagcccatcgacgaccggttcgcctccgccctgaccgccctcaacgacatggggaagatccgcaaggacatccagcagtgggagcccagccggggctggaacgactggacccaggtccccttctgctcccaccacttccacgagctggtgatgaaggacgggcgcgtgctggtcgtgccgtgccggaaccaggacgagctcatcggccgcgcgcggatcagccagggcgccgggtggtccctgaaggagaccgcctgcctgggcaagagctacgcccagatgtggaccctcatgtacttccaccgccgggacctgcgcctggccgcgaacgccatctgctccgccgtgcccagccactgggtccccacgtcccggaccacctggagcatccacgccaagcacgagtggatgaccacggaggacatgctcgcggtgtggaaccgcgtgtggatccaggagaacccctggatggaggacaagaccccggtcgagtcctgggaggaggtgccctacctggggaagcgggaggaccagtggtgcggcagcctgatcgggctcaccagccgcgccacctgggccaagaacatccagacggccatcaaccaggtgcggtccctgatcggcaacgaggagtacaccgactacatgcccagcatgaagcgcttccgccgggaggaggaggaggccggcgtcctgtggtga

SEQ ID NO: 9268 - RNA, 9876 nt, synthetic construct
  misc_feature 1..9876: note = derived and/or modified CDS sequence (opt1) from DENV-2__EU482751__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatgggcctggggaagggctggcccctgtccaagatggacatcggggtgcccctcctggcgatcggctgctacagccaggtgaacccgatcaccctgaccgccgccctcctgctgctcgtcgcccactacgccatcatcgggcccggcctgcaggcgaaggccacccgcgaggcccagaagcgggccgccgcgggcatcatgaagaaccccacggtggacgggatcaccgtgatcgacctggagcccatcccgtacgaccccaagttcgagaagcagctcggccaggtcatgctgctgatcctctgcgtgacccaggtgctgatgatgcgcaccacgtgggccctgtgcgaggccctcaccctggccaccgggcccatctccaccctgtgggagggcaaccccgggcggttctggaacacgaccatcgccgtcagcatggcgaacatcttccgcggctcctacctcgccggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagacggaccaccacgccgtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacctacgggtggaacctggtccgcctccagagcggcgtggacgtgttcttcacgccgcccgagaagtgcgacaccctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacgcacgagatgtactgggtgagcaacgccaccggcaacatcgtctccagcgtgaacatgatctcccgcatgctgatcaaccggttcaccatgaagcacaagaaggccacctacgagccggacgtggacctggggagcggcacgcgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagaccgggagcgcctccagcatggtcaacggcgtggtgcgcctgctgacgaagccctgggacgtcgtgccgatggtgacccagatggcgatgaccgacaccacgcccttcgggcagcagcgcgtcttcaaggagaaggtggacacccggacccaggagcccaaggagggcaccaagaagctcatgaagatcacggccgagtggctgtggaaggagctgggcaagaagaagacgccccgcatgtgcacccgggaggagttcacccgcaaggtgcggtccaacgccgccctcggggccatcttcacggacgagaacaagtggaagtccgcgcgcgaggccgtcgaggacggccggttctgggagctggtggaccgcgagcggaacctgcacctcgaggggaagtgcgagacctgcgtgtacaacatgatgggcaagcgcgagaagaagctgggggagttcggcaaggccaagggctcccgggccatctggtacatgtggctgggggcgcgcttcctcgagttcgaggccctgggcttcctgaacgaggaccactggttcagccgggggaacagcctctccggcgtcgagggggagggcctgcaccgcctgggctacatcctccgggacgtggggaagaaggagggcggggccatgtacgccgacgacaccgccggctgggacacccgcatcacgctggaggacctgaagaacgaggagatggtcaccaaccacatgaagggggagcacaagaagctcgcggaggccatcttcaagctgacctaccagaacaaggtggtgcgggtccagcgcccgacgccccggggcacggtgatggacatcatcagccgccgggaccagcgcggctccgggcaggtcggcacctacgggctgaacaccttcaccaacatggaggcccagctcatccgccagatggagggcgagggcatcttcaagagcatccagcacctgacggccaccgaggagatcgccgtccagaactggctggcgcgggtggggcgcgagcggctctcccgcatggccatcagcggcgacgactgcgtggtcaagcccatcgacgaccggttcgcctccgccctgaccgccctgaacgacatggggaaggtgcgcaaggacatccagcagtgggagcccagccggggctggaacgactggacccaggtgccgttctgctcccaccacttccacgagctcgtcatgaaggacgggcgcgtgctggtggtcccctgccggaaccaggacgagctgatcggccgcgcgcggatcagccagggcgccgggtggtccctcaaggagacggcctgcctgggcaagagctacgcccagatgtggaccctgatgtacttccaccgccgggacctccgcctggccgcgaacgccatctgctccgccgtgcccagccactgggtgcccacctcccggaccacctggagcatccacgccaagcacgagtggatgacgaccgaggacatgctggcggtctggaaccgcgtgtggatccaggagaacccgtggatggaggacaagacccccgtggagtcctgggaggaggtcccctacctcgggaagcgggaggaccagtggtgcggcagcctgatcgggctgaccagccgcgccacgtgggccaagaacatccaggccgccatcaaccaggtgcggtccctcatcggcaacgaggagtacaccgactacatgcccagcatgaagcgcttccgccgggaggaggaggaggcgggcgtgctgtggtga

SEQ ID NO: 9269 - RNA, 9876 nt, synthetic construct
  misc_feature 1..9876: note = derived and/or modified CDS sequence (opt1) from DENV-2__GQ868604__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacctgtgcgaggggaccaccgtggtcgtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtcaccgccgggcggggccagatcgacaacttctccctgggcgtgctggggatggccctcttcctggaggagatgctgcgcacccggatcggcacgaagcacgcgatcctcctggtggccgtcagcttcgtgaccctgatcaccgggaacatgtccttccgcgacctcggccgcgtgatggtcatggtgggggccaccatgacggacgacatcggcatgggcgtgacctacctggccctgctcgccgcgttcaaggtccggcccaccttcgccgccgggctgctgctccgcaagctgaccagcaaggagctgatgatggccacgatcggcatcgccctcctgtcccagagcaccatccccgagaacatcctggagctcaccgacgcgctggccctggggatgatggtgctcaagatcgtgcggaacatggagaagtaccagctggccgtcaccatcatggccatctcctgcgtgccgaacgccgtgatcctgcagaacgcgtggaaggtcagctgcacgatcctcgccgccgtgtccgtcagccccctgctgctcacctccagccagcagaaggccgactggatccccctggcgctgaccatcaagggcctcaaccccaccgccatcttcctgacgaccctgtcccgcaccagcaagaagcggtcctggccgctcaacgaggccatcatggccgtgggcatggtgagcatcctggcctccagcctgctcaagaacgacatccccatgaccgggcccctggtcgcgggcgggctgctcacggtgtgctacgtgctgaccggccgcagcgccgacctggagctcgagcgggccgccgacgtcaagtgggaggaccaggccgagatctccgggagctcccccatcctgagcatcaccatctccgaggacggcagcatgtccatcaagaacgaggaggaggagcagaccctgacgatcctcatccgcaccggcctgctggtgatcagcggggtgttcccggtctccatccccatcaccgcggccgcctggtacctctgggaggtgaagaagcagcgggccggcgtgctgtgggacgtccccagcccgccgcccgtggagaaggccgagctggaggacggggcgtaccgcatcaagcagcggggcatcctcgggtactcccagatcggcgccggcgtgtacaaggaggggaccttccacaccatgtggcacgtcacgcgcggcgccgtgctgatgcaccgggggaagcgcatcgagcccagctgggccgacgtgaagaaggacctgatctcctacggcgggggctggaagctcgagggcgagtggaaggagggggaggaggtccaggtgctggccctggagcccggcaagaacccccgggcggtgcagaccaagcccgggatcttcaagaccaacaccggcacgatcggggccgtcagcctcgacttctcccccggcaccagcggctcccccatcgtggaccgcaaggggaaggtggtcggcctgtacgggaacggcgtggtgacccggagcggcgcctacgtctccgccatcgcgcagaccgagaagtccatcgaggacaaccccgagatcgaggacgacatcttccgcaagaagcggctgacgatcatggacctccaccccggggccggcaagaccaagcgctacctgcccgccatcgtgcgggaggccatcaagcgcgggctgcgcaccctgatcctcgccccgacccgggtggtcgcggccgagatggaggaggccctgcgcggcctgcccatccggtaccagacgcccgccatcaagaccgagcacaccgggcgcgagatcgtggacctcatgtgccacgccaccttcacgatgcggctgctgagccccgtgcgcgtcccgaactacaacctcatcatcatggacgaggcgcacttcaccgaccccgcctccatcgccgcccggggctacatcagcacccgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtgaccgacttcaagggcaagaccgtctggttcgtgccgtccatcaaggccgggaacgacatcgcggcctgcctgcgcaagaacggcaagaaggtgatccagctgagccggaagaccttcgactccgagtacgtcaagacgcgcgccaacgactgggacttcgtggtgaccaccgacatcagcgagatgggcgccaacttcaaggccgagcgggtcatcgacccccgccggtgcatgaagcccgtgatcctcaccgacggggaggagcgcgtgatcctggcgggccccatgccggtcacgcactccagcgccgcccagcggcgcgggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtggacgcgatcgacggcgagtaccggctgcgcggggaggcccggaagaccttcgtggacctcatgcgccggggcgacctgcccgtctggctggcctacaaggtggccgccgaggggatcaactacgcggaccgcaagtggtgcttcgacggcatcaagaacaaccagatcctcgaggagaacatggaggtggagatctggaccaaggagggggagcggaagaagctgaagccgcgctggctggacgcccggatctacagcgaccccctcgccctgaaggagttcaaggagttcgccgcgggccgcaagtccctgacgctcaacctgatcaccgagatgggccggctgcccaccttcatgacccagaaggcccgcaacgccctcgacaacctggccgtcctgcacacggccgaggccgggggccgggcctacaaccacgccctcagcgagctgcccgagaccctggagaccctcctgctgctcaccctgctggccacggtgaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtcctgctgatccccgagcccgagaagcagcgcacgccccaggacaaccagctcacgtacgtggtgatcgccatcctgaccgtcgtggccgcgaccatggccaacgagatgggcttcctggagaagaccaagaaggacctcgggctgggcagcatcacgacccaggagagcgagtccaacatcctggacatcgacctccggccggccagcgcctggaccctgtacgccgtggcgaccacgttcgtcacccccatgctgcgccactccatcgagaacagctccgtgaacgtgagcctcaccgccatcgccaaccaggccaccgtcctgatgggcctggggaagggctggcccctctccaagatggacatcggggtgcccctgctggcgatcggctgctacagccaggtgaacccgatcacgctcaccgccgccctgctgctcctggtcgcccactacgccatcatcgggcccggcctgcaggcgaaggccacccgggaggcccagaagcgcgccgccgcgggcatcatgaagaaccccaccgtggacgggatcacggtgatcgacctcgagcccatcccgtacgaccccaagttcgagaagcagctgggccaggtcatgctgctcatcctgtgcgtgacccaggtgctgatgatgcggaccacctgggccctctgcgaggccctgacgctggccaccgggcccatctccaccctctgggagggcaaccccgggcgcttctggaacaccacgatcgccgtcagcatggcgaacatcttccgcggctcctacctggccggcgccgggctcctgttcagcatcatgaagaacaccacctccacccggcgcggcacggggaacatcggcgagaccctgggcgagaagtggaagtcccggctgaacgccctcgggaagtccgagttccagatctacaagaagtccggcatccaggaggtggaccgcaccctggcgaaggaggggatcaagcggggcgagaccgaccaccacgccgtgtcccgcgggagcgccaagctgcggtggttcgtcgagcgcaacatggtgacgccggagggcaaggtggtcgacctcggctgcgggcggggcgggtggtcctactactgcggcgggctgaagaacgtgcgcgaggtgaagggcctgaccaagggcgggcccggccacgaggagcccatccccatgagcacctacgggtggaacctcgtccggctgcagagcggcgtggacgtgttcttcaccccgcccgagaagtgcgacacgctgctctgcgacatcggggagtccagccccaaccccaccatcgaggccggccgcaccctgcgggtcctgaacctcgtggagaactggctgaacaacaacacccagttctgcatcaaggtgctgaacccgtacatgccctccgtcatcgagaagatggaggccctccagcgccagtacggcggggcgctggtgcggaaccccctgagccgcaactccacccacgagatgtactgggtgagcaacgccacgggcaacatcgtctccagcgtgaacatgatctcccggatgctgatcaaccgcttcaccatgaagcacaagaaggccacctacgagccggacgtggacctcgggagcggcacccggaacatcgggatcgagtccgagatccccaacctggacatcatcggcaagcgcatcgagaagatcaagcaggagcacgagatcagctggcactacgaccaggaccacccctacaagacgtgggcctaccacggctcctacgagaccaagcagaccgggagcgcctccagcatggtcaacggcgtggtgcgcctgctcaccaagccctgggacgtcgtgccgatggtgacgcagatggcgatgaccgacaccacccccttcgggcagcagcgggtcttcaaggagaaggtggacacgcgcacccaggagcccaaggagggcaccaagaagctgatgaagatcaccgccgagtggctgtggaaggagctcggcaagaagaagacgccccggatgtgcacccgcgaggagttcaccaagaaggtgcggtccaacgccgccctgggggccatcttcaccgacgagaacaagtggaagtccgcgcgcgaggccgtcgaggacggccggttctgggagctggtggaccgcgagcggaacctccacctggaggggaagtgcgagacgtgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtcgagggggagggcctgcaccgcctcggctacatcctgcgggacgtggggaagaaggagggcggggccatgtacgccgacgacaccgccggctgggacacccgcatcaccctggaggacctcaagaacgaggagatggtcacgaaccacatgaagggggagcacaagaagctggcggaggccatcttcaagctgacctaccagaacaaggtggtgcgggtccagcgcccgacgccccggggcaccgtgatggacatcatcagccgccgggaccagcgcggctccgggcaggtcggcacgtacgggctcaacaccttcaccaacatggaggcccagctgatccgccagatggagggcgagggcatcttcaagagcatccagcacctgaccgccacggaggagatcgccgtccagaactggctcgcgcgggtggggcgcgagcggctgtcccgcatggccatcagcggcgacgactgcgtggtcaagcccatcgacgaccggttcgcctccgccctgaccgccctcaacgacatggggaaggtgcgcaaggacatccagcagtgggagcccagccggggctggaacgactggacccaggtgccgttctgctcccaccacttccacgagctggtcatgaaggacgggcgcgtgctggtggtcccctgccggaaccaggacgagctcatcggccgcgcgcggatcagccagggcgccgggtggtccctgaaggagaccgcctgcctgggcaagagctacgcccagatgtggacgctcatgtacttccaccgccgggacctgcgcctggccgcgaacgccatctgctccgccgtgcccagccactgggtgcccacctcccggaccacctggagcatccacgccaagcacgagtggatgaccacggaggacatgctcgcggtctggaaccgcgtgtggatccaggagaacccgtggatggaggacaagacccccgtggagtcctgggaggaggtcccctacctggggaagcgggaggaccagtggtgcggcagcctgatcgggctcaccagccgcgccacctgggccaagaacatccagacggccatcaaccaggtgcggtccctgatcggcaacgaggagtacaccgactacatgcccagcatgaagcgcttccgccgggaggaggaggaggccggcgtgctgtggtga

SEQ ID NO: 9270 - RNA, 9876 nt, synthetic construct
  misc_feature 1..9876: note = derived and/or modified CDS sequence (opt1) from DENV-2__EU482752__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaacatcctggagctcaccgacgcgctggccctggggatgatggtcctcaagatcgtgcggaacatggagaagtaccagctggccgtgaccatcatggccatctcctgcgtcccgaacgccgtgatcctgcagaacgcgtggaaggtgagctgcacgatcctcgccgccgtctccgtgagccccctgctgctcacctccagccagcagaaggccgactggatccccctggcgctgaccatcaagggcctcaaccccaccgccatcttcctgacgaccctgtcccgcaccagcaagaagcggtcctggccgctcaacgaggccatcatggccgtcggcatggtgagcatcctggcctccagcctgctcaagaacgacatccccatgaccgggcccctggtggcgggcgggctgctcacggtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagaccctgacgatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacaccatgtggcacgtgacgcgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacaccggcacgatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagaccgagaagtccatcgaggacaaccccgagatcgaggacgacatcttccgcaagaagcggctgacgatcatggacctccaccccggggccggcaagaccaagcgctacctgcccgccatcgtccgggaggccatcaagcgcgggctgcgcaccctgatcctcgccccgacccgggtggtggcggccgagatggaggaggccctgcgcggcctgcccatccggtaccagacgaccgccatcaagaccgagcacaccgggcgcgagatcgtcgacctcatgtgccacgccacgttcaccatgcggctgctgagccccgtgcgcgtgcccaactacaacctcatcatcatggacgaggcgcacttcaccgacccggcctccatcgccgcccggggctacatcagcacccgcgtcgagatgggcgaggccgcggggatcttcatgacggccacgccgcccggctcccgggaccccttcccgcagagcaacgcccccatcatggacgaggagcgcgagatccccgagcggtcctggaacagcgggcacgagtgggtgaccgacttcaagggcaagaccgtgtggttcgtcccctccatcaaggccgggaacgacatcgcggcctgcctgcgcaagaacggcaagaaggtgatccagctgagccggaagacgttcgactccgagtacgtgaagacccgcgccaacgactgggacttcgtcgtgaccaccgacatcagcgagatgggcgccaacttcaaggccgagcgggtgatcgacccgcgccggtgcatgaagcccgtcatcctcacggacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagaccttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggacgaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccaccttcatgacgcagaaggcccgcaacgccctcgacaacctggccgtgctgcacaccgccgaggccgggggccgggcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccggcccgccagcgcctggaccctgtacgccgtggcgacgaccttcgtgaccccgatgctgcgccactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacccgggaggcccagaagcgcgccgccgcgggcatcatgaagaaccccacggtcgacgggatcaccgtgatcgacctcgagcccatcccctacgacccgaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaaccccgggcgcttctggaacacgaccatcgccgtgagcatggcgaacatcttccgcggctcctacctggccggcgccgggctcctgttcagcatcatgaagaacaccaccaacacgcggcgcggcaccgggaacatcggcgagaccctgggcgagaagtggaagtcccggctgaacgccctcggcaagagcgagttccagatctacaagaagtccggcatccaggaggtcgaccgcaccctggcgaaggaggggatcaagcggggcgagacggaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacctacgggtggaacctcgtgcggctgcagagcggcgtcgacgtgttcttcacgcccccggagaagtgcgacaccctgctctgcgacatcggggagagctcccccaaccccaccatcgaggccggccgcaccctgcgggtgctgaacctcgtcgagaactggctgaacaacaacacccagttctgcatcaaggtgctgaacccctacatgccgagcgtgatcgagaagatggaggccctccagcgcaagtacggcggggcgctggtccggaaccccctgtcccgcaacagcacgcacgagatgtactgggtgtccaacgccaccggcaacatcgtgagctccgtcaacatgatcagccggatgctgatcaaccgcttcaccatgaagcacaagaaggccacctacgagcccgacgtggacctcgggtccggcacgcggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccctgggacgtggtccccatggtgacccagatggcgatgaccgacacgaccccgttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacaccgccggctgggacacgcggatcaccctggaggacctcaagaacgaggagatggtgaccaaccacatgaagggggagcacaagaagctggcggaggccatcttcaagctgacctaccagaacaaggtcgtgcgcgtgcagcggcccacgccgcgcggcaccgtcatggacatcatctcccggcgcgaccagcgcggcagcgggcaggtcggcacctacgggctcaacaccttcacgaacatggaggcccagctgatccggcagatggagggcgagggcatcttcaagtccatccagcacctgaccgccaccgaggagatcgccgtgcagaactggctcgcgcgcgtcgggcgggagcgcctgagccggatggccatctccggcgacgactgcgtggtgaagcccatcgacgaccgcttcgccagcgccctgaccgccctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtcccctcccactgggtgcccaccagccgcaccacgtggtccatccacgccaagcacgagtggatgaccaccgaggacatgctcgcggtgtggaaccgggtctggatccaggagaacccctggatggaggacaagaccccggtggagagctgggaggaggtgccctacctggggaagcgcgaggaccagtggtgcggctccctgatcgggctcacgagccgggccacctgggccaagaacatccagaccgccatcaaccaggtccgcagcctgatcggcaacgaggagtacaccgactacatgccctccatgaagcgcttccggcgcgaggaggaggaggccggcgtgctgtggtga

SEQ ID NO: 9271 - RNA, 9876 nt, synthetic construct
  misc_feature 1..9876: note = derived and/or modified CDS sequence (opt1) from DENV-2__EU482753__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccttcgtgaccccgatgctgcgccactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacgtacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacggcggggcgctggtccggaaccccctgtcccgcaacagcacccacgagatgtactgggtgtccaacgccaccggcaacatcgtgagctccgtcaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggcccaccccgcgcggcaccgtcatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtgcagaactggctcgcgcgcgtcgggcgggagcgcctgagccggatggccatctccggcgacgactgcgtggtgaagcccatcgacgaccgcttcgccagcgccctgacggccctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtcccctcccactgggtgcccaccagccgcacgacctggtccatccacgccaagcacgagtggatgaccaccgaggacatgctcgcggtgtggaaccgggtctggatccaggagaacccctggatggaggacaagacgccggtggagagctgggaggaggtgccctacctggggaagcgcgaggaccagtggtgcggctccatgatcgggctgaccagccgggccacctgggccaagaacatccagaccgccatcaaccaggtccgcagcctcatcggcaacgaggagtacacggactacatgccctccatgaagcgcttccggcgcgaggaggaggaggccggcgtgctgtggtga

SEQ ID NO: 9272 - RNA, 9876 nt, synthetic construct
  misc_feature 1..9876: note = derived and/or modified CDS sequence (opt1) from DENV-2__EU482680__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtcttcggcgcgatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccggccgggctaccacacgcagaccgcggggccctggcacctcggcaagctggagatggacttcgacctgtgcgaggggaccaccgtcgtggtgacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtcaacagcctcgtgaccgccgggcacggccagatcgacaacttctccctgggcgtgctggggatggccctcttcctggaggagatgctgcgcacccggatcggcacgaagcacgcgatcctcctggtcgccgtgagcttcgtgaccctgatcaccgggaacatgtccttccgcgacctcggccgcgtcatggtgatggtgggggccaccatgacggacgacatcggcaccggcgtcacctacctggccctgctcgccgcgttcaaggtgcggcccaccttcgccgccgggctgctgctccgcaagctgacgagcaaggagctgatgatggccaccatcggcatcgccctcctgtcccagagcaccatccccgagaccatcctggagctcacggacgcgctggccctggggatgatggtgctcaagatcgtccggaacatggagaagtaccagctggccgtgaccatcatggccatctcctgcgtgccgaacgccgtcatcctgcagaacgcgtggaaggtgagctgcaccatcctcgccgccgtgtccgtcagccccctgctgctcacctccagccagcagaaggccgactggatccccctggcgctgacgatcaagggcctcaaccccaccgccatcttcctgaccaccctgtcccgcacgagcaagaagcggtcctggccgctcaacgaggccatcatggccgtgggcatggtcagcatcctggcctccagcctgctcaagaacgacatccccatgaccgggcccctggtggcgggcgggctgctcaccgtgtgctacgtcctgaccggccgcagcgccgacctggagctcgagcgggccgccgacgtgaagtgggaggaccaggccgagatctccgggagctcccccatcctgagcatcacgatctccgaggacggcagcatgtccatcaagaacgaggaggaggagcagaccctgaccatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggagaaggccgagctggaggacggggcgtaccgcatcaagcagcggggcatcctcgggtactcccagatcggcgccggcgtctacaaggaggggacgttccacaccatgtggcacgtgacccgcggcgccgtgctgatgcaccgggggaagcgcatcgagcccagctgggccgacgtcaagaaggacctgatctcctacggcgggggctggaagctcgagggcgagtggaaggagggggaggaggtccaggtgctggccctggagcccggcaagaacccccgggcggtccagaccaagcccgggatcttcaagacgaacaccggcaccatcggggccgtgagcctcgacttctcccccggcaccagcggctcccccatcgtggaccgcaaggggaaggtcgtgggcctgtacgggaacggcgtggtcacgcggagcggcgcctacgtgtccgccatcgcgcagaccgagaagtccatcgaggacaaccccgagatcgaggacgacatcttccgcaagaagcggctgaccatcatggacctccaccccggggccggcaagaccaagcgctacctgcccgccatcgtgcgggaggccatcaagcgcgggctgcgcacgctgatcctcgccccgacccgggtcgtggcggccgagatggaggaggccctgcgcggcctgcccatccggtaccagaccaccgccatcaagacggagcacaccgggcgcgagatcgtggacctcatgtgccacgccaccttcaccatgcggctgctgagccccgtccgcgtgcccaactacaacctcatcatcatggacgaggcgcacttcacggacccggcctccatcgccgcccggggctacatcagcacccgcgtggagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtcacggacttcaagggcaagaccgtgtggttcgtgccctccatcaaggccgggaacgacatcgcggcctgcctgcgcaagaacggcaagaaggtcatccagctgagccggaagaccttcgactccgagtacgtgaagacccgcgccaacgactgggacttcgtggtcacgaccgacatcagcgagatgggcgccaacttcaaggccgagcgggtgatcgacccgcgccggtgcatgaagcccgtgatcctcaccgacggggaggagcgcgtcatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacgcccgagggcatcatcccctccatgttcgagccggagcgcgagaaggtggacgcgatcgacggcgagtaccggctgcgcggggaggcccggaagaccttcgtcgacctcatgcgccggggcgacctgcccgtgtggctggcctacaaggtggccgccgaggggatcaactacgcggaccgcaagtggtgcttcgacggcatcaagaacaaccagatcctcgaggagaacatggaggtcgagatctggaccaaggagggggagcggaagaagctgaagccccgctggctggacgcccggatctacagcgacccgctcgccctgaaggagttcaaggagttcgccgcgggccgcaagtccctgaccctcaacctgatcacggagatgggccggctgcccaccttcatgacccagaaggcccgcaacgccctcgacaacctggccgtgctgcacaccgccgaggccgggggccgggcctacaaccacgccctcagcgagctgcccgagacgctggagaccctcctgctgctcaccctgctggccaccgtgaccgggggcatcttcctcttcctgatgtccggcaaggggatcggcaagatgacgctggggatgtgctgcatcatcaccgccagcatcctcctgtggtacgcgcagatccagccccactggatcgccgcctccatcatcctggagttcttcctcatcgtcctgctgatcccggagcccgagaagcagcgcacgccccaggacaaccagctcacctacgtggtcatcgccatcctgacggtggtggccgcgaccatggccaacgagatgggcttcctggagaagaccaagaaggacctcgggctgggcagcatcaccacgcaggagagcgagtccaacatcctggacatcgacctccggcccgccagcgcctggaccctgtacgccgtcgcgaccaccttcgtgacgccgatgctgcgccactccatcgagaacagctccgtgaacgtcagcctcaccgccatcgccaaccaggccaccgtgctgatgggcctggggaagggctggcccctctccaagatggacatcggggtgcccctgctggcgatcggctgctacagccaggtcaaccccatcaccctcacggccgccctgctgctcctggtggcccactacgccatcatcgggccgggcctgcaggcgaaggccacccgggaggcccagaagcgcgccgccgcgggcatcatgaagaaccccaccgtggacgggatcaccgtcatcgacctcgagcccatcccctacgacccgaagttcgagaagcagctgggccaggtgatgctgctcatcctgtgcgtgacgcaggtcctgatgatgcggaccacctgggccctctgcgaggccctgaccctggccacggggcccatctccaccctctgggagggcaaccccgggcgcttctggaacaccaccatcgccgtgagcatggcgaacatcttccgcggctcctacctggccggcgccgggctcctgttcagcatcatgaagaacacgaccaacacccggcgcggcaccgggaacatcggcgagacgctgggcgagaagtggaagtcccggctgaacgccctcggcaagagcgagttccagatctacaagaagtccggcatccaggaggtggaccgcaccctggcgaaggaggggatcaagcggggcgagaccgaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgacgaagggcgggccgggccacgaggagcccatccccatgtccacctacgggtggaacctcgtgcggctgcagagcggcgtggacgtcttcttcacgccgcccgagaagtgcgacaccctgctctgcgacatcggggagagctcccccaaccccaccatcgaggccggccgcacgctgcgggtgctgaacctcgtggagaactggctgaacaacaacacccagttctgcatcaaggtcctgaacccctacatgcccagcgtgatcgagaagatggaggccctccagcgcaagtacggcggggcgctggtgcggaaccccctgtcccgcaacagcacccacgagatgtactgggtctccaacgccaccggcaacatcgtgagctccgtgaacatgatcagccggatgctgatcaaccgcttcacgatgaagcacaagaaggccacctacgagcccgacgtcgacctcgggtccggcacccggaacatcgggatcgagagcgagaagccgaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtgaacggcgtggtccgcctgctcaccaagccctgggacgtggtgcccatggtcacgcagatggcgatgaccgacaccaccccgttcgggcagcagcgggtgttcaaggagaaggtggacacgcgcacccaggagcccaaggagggcaccaagaagctgatgaagatcaccgccgagtggctgtggaaggagctcggcaagaagaagacgccccggatgtgcacccgcgaggagttcacccggaaggtccgcagcaacgccgccctgggggccatcttcaccgacgagaacaagtggaagtccgcgcgggaggccgtggaggacggccgcttctgggagctggtggaccgggagcgcaacctccacctggaggggaagtgcgagacgtgcgtctacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtggggaagaaggagggcggggccatgtacgccgacgacaccgccggctgggacacccggatcaccctggaggacctcaagaacgaggagatggtcacgaaccacatgaagggggagcacaagaagctggcggaggccatcttcaagctgacctaccagaacaaggtggtccgcgtgcagcggcccaccccgcgcggcaccgtgatggacatcatctcccggcgcgaccagcgcggcagcgggcaggtcggcacgtacgggctcaacaccttcaccaacatggaggcccagctgatccggcagatggagggcgagggcatcttcaagtccatccagcacctgaccgccacggaggagatcgccgtgcagaactggctcgcgcgcgtggggcgggagcgcctgagccggatggccatctccggcgacgactgcgtcgtgaagcccatcgacgaccgcttcgccagcgccctgaccgccctcaacgacatggggaaggtgcggaaggacatccagcagtgggagccctcccgcggctggaacgactggacccaggtccccttctgcagccaccacttccacgagctggtgatgaaggacgggcgggtgctggtcgtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtgccctcccactgggtccccacgagccgcaccacctggtccatccacgccaagcacgagtggatgaccacggaggacatgctcgcggtgtggaaccgggtgtggatccaggagaacccctggatggaggacaagaccccggtcgagagctgggaggaggtgccctacctggggaagcgcgaggaccagtggtgcggctccctgatcgggctcaccagccgggccacctgggccaagaacatccagacggccatcaaccaggtgcgcagcctgatcggcaacgaggagtacaccgactacatgccctccatgaagcgcttccggcgcgaggaggaggaggccggcgtcctgtggtga

SEQ ID NO: 9273 - RNA, 9876 nt, synthetic construct
  misc_feature 1..9876: note = derived and/or modified CDS sequence (opt1) from DENV-2__EU482754__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacatccacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccggccgggctaccacacgcagaccgcggggccctggcacctcggcaagctggagatggacttcgacctgtgcgaggggaccaccgtcgtggtgacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtcaacagcctcgtgaccgccgggcacggccagatcgacaacttctccctgggcgtgctggggatggccctcttcctggaggagatgctgcgcacccggatcggcacgaagcacgcgatcctcctggtcgccgtgagcttcgtgaccctgatcaccgggaacatgtccttccgcgacctcggccgcgtcatggtgatggtgggggccaccatgacggacgacatcggcatgggcgtcacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtgctcaagatcgtccggaacatggagaagtaccagctggccgtgacgatcatggccatctcctgcgtgccgaacgccgtcatcctgcagaacgcgtggaaggtgagctgcaccatcctcgccgccgtgtccgtcagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtgggcatggtcagcatcctggcctccagcctgctcaagaacgacatccccatgacggggcccctggtggcgggcgggctgctcaccgtgtgctacgtcctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggagaaggccgagctggaggacggggcgtaccgcatcaagcagcggggcatcctcgggtactcccagatcggcgccggcgtctacaaggaggggaccttccacacgatgtggcacgtgacccgcggcgccgtgctgatgcaccgggggaagcgcatcgagcccagctgggccgacgtcaagaaggacctgatctcctacggcgggggctggaagctcgagggcgagtggaaggagggggaggaggtccaggtgctggccctggagcccggcaagaacccccgggcggtccagaccaagcccgggatcttcaagaccaacacgggcaccatcggggccgtgagcctcgacttctcccccggcaccagcggctcccccatcgtggaccgcaaggggaaggtcgtgggcctgtacgggaacggcgtggtcacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtgcgggaggccatcaagcgcgggctgcgcaccctgatcctcgccccgacgcgggtcgtggcggccgagatggaggaggccctgcgcggcctgcccatccggtaccagaccaccgccatcaagaccgagcacacggggcgcgagatcgtggacctcatgtgccacgccaccttcaccatgcggctgctgagccccgtccgcgtgcccaactacaacctcatcatcatggacgaggcgcacttcaccgacccggcctccatcgccgcccggggctacatcagcacgcgcgtggagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtcaccgacttcaagggcaagacggtgtggttcgtgccctccatcaaggccgggaacgacatcgcggcctgcctgcgcaagaacggcaagaaggtcatccagctgagccggaagaccttcgactccgagtacgtgaagacccgcgccaacgactgggacttcgtggtcaccacggacatcagcgagatgggcgccaacttcaaggccgagcgggtgatcgacccgcgccggtgcatgaagcccgtgatcctcaccgacggggaggagcgcgtcatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtggacgcgatcgacggcgagtaccggctgcgcggggaggcccggaagacgttcgtcgacctcatgcgccggggcgacctgcccgtgtggctggcctacaaggtggccgccgaggggatcaactacgcggaccgcaagtggtgcttcgacggcatcaagaacaaccagatcctcgaggagaacatggaggtcgagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtcctgctgatcccggagcccgagaagcagcgcacgccccaggacaaccagctcacctacgtggtcatcgccatcctgaccgtggtggccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtcgcgaccaccttcgtgaccccgatgctgcgccactccatcgagaacagctccgtgaacgtcagcctcacggccatcgccaaccaggccaccgtgctgatgggcctggggaagggctggcccctctccaagatggacatcggggtgcccctgctggcgatcggctgctacagccaggtcaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtggacgggatcaccgtcatcgacctcgagcccatcccctacgacccgaagttcgagaagcagctgggccaggtgatgctgctcatcctgtgcgtgacccaggtcctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtggaccgcacgctggcgaaggaggggatcaagcggggcgagaccgaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgaccaagggcgggccgggccacgaggagcccatccccatgtccacgtacgggtggaacctcgtgcggctgcagagcggcgtggacgtcttcttcacgccgcccgagaagtgcgacaccctgctctgcgacatcggggagagctcccccaaccccaccatcgaggccggccgcaccctgcgggtgctgaacctcgtggagaactggctgaacaacaacacgcagttctgcatcaaggtcctgaacccctacatgcccagcgtgatcgagaagatggaggccctccagcgcaagtacggcggggcgctggtgcggaaccccctgtcccgcaacagcacccacgagatgtactgggtctccaacgccaccggcaacatcgtgagctccgtgaacatgatcagccggatgctgatcaaccgcttcaccatgaagcacaagaaggccacgtacgagcccgacgtcgacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtggtccgcctgctcaccaagccctgggacgtggtgcccatggtcacccagatggcgatgacggacaccaccccgttcgggcagcagcgggtgttcaaggagaaggtggacacccgcacgcaggagcccaaggagggcaccaagaagctgatgaagatcaccgccgagtggctgtggaaggagctcggcaagaagaagacgccccggatgtgcacgcgcgaggagttcacccggaaggtccgcagcaacgccgccctgggggccatcttcaccgacgagaacaagtggaagtccgcgcgggaggccgtggaggacggccgcttctgggagctggtggaccgggagcgcaacctccacctggaggggaagtgcgagacctgcgtctacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtggggaagaaggagggcggggccatgtacgccgacgacacggccggctgggacacccggatcaccctggaggacctcaagaacgaggagatggtcaccaaccacatgaagggggagcacaagaagctggcggaggccatcttcaagctgacgtaccagaacaaggtggtccgcgtgcagcggcccaccccgcgcggcaccgtgatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtgcagaactggctcgcgcgcgtggggcgggagcgcctgagccggatggccatctccggcgacgactgcgtcgtgaagcccatcgacgaccgcttcgccagcgccctgacggccctcaacgacatggggaaggtgcggaaggacatccagcagtgggagccctcccgcggctggaacgactggacccaggtccccttctgcagccaccacttccacgagctggtgatgaaggacgggcgggtgctggtcgtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtgccctcccactgggtccccaccagccgcacgacctggtccatccacgccaagcacgagtggatgaccaccgaggacatgctcgcggtgtggaaccgggtgtggatccaggagaacccctggatggaggacaagacgccggtcgagagctgggaggaggtgccctacctggggaagcgcgaggaccagtggtgcggctccctgatcgggctcaccagccgggccacctgggccaagaacatccagaccgccatcaaccaggtgcgcagcctgatcggcaacgaggagtacacggactacatgccctccatgaagcgcttccggcgcgaggaggaggaggccggcgtcctgtggtga

SEQ ID NO: 9274 - RNA, 9876 nt, synthetic construct
  misc_feature 1..9876: note = derived and/or modified CDS sequence (opt1) from DENV-2__FJ478455__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgtggagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggccgtgcacgcggacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacgcagaccgccgggccctggcacctcggcaagctggagatggacttcgacttctgcgaggggaccaccgtcgtggtgacggaggactgcggcaaccggggccccagcctgcgcaccaccaccgcgagcgggaagctcatcacggagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcatcggcacgaagcacgccatcctgctcgtcgcggtgagcttcgtgaccctgatcaccgggaacatgtccttccgggacctgggccgcgtcatggtgatggtgggggccaccatgacggacgacatcggcatgggcgtcacctacctcgccctgctggccgccttcaaggtgcgccccaccttcgcggccgggctcctgctgcggaagctcaccagcaaggagctgatgatggccacgatcggcatcgccctgctctcccagagcaccatccccgagaccatcctggagctgaccgacgccctcgcgctggggatgatggtgctgaagatcgtccgcaacatggagaagtaccagctcgccgtgacgatcatggccatctcctgcgtgccgaacgccgtcatcctgcagaacgcctggaaggtgagctgcaccatcctggcggccgtctccgtgagccccctcctgctgacctccagccagcagaaggccgactggatccccctcgccctgaccatcaagggcctgaaccccacggcgatcttcctcaccaccctgtcccggaccagcaagaagcgctcctggccgctgaacgaggccatcatggccgtgggcatggtcagcatcctcgcctccagcctgctgaagaacgacatccccatgacggggcccctcgtggccggcgggctgctgaccgtgtgctacgtcctcaccggccggagcgcggacctggagctggagcgcgccgccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtcttcccggtgtccatccccatcaccgccgcggcctggtacctgtgggaggtgaagaagcagcgcgccggcgtcctctgggacgtgcccagcccgccgcccgtggagaaggccgagctggaggacggggcctaccggatcaagcagcgcggcatcctggggtactcccagatcggcgcgggcgtctacaaggaggggaccttccacacgatgtggcacgtgacccggggcgccgtgctcatgcaccgcgggaagcggatcgagcccagctgggccgacgtcaagaaggacctgatctcctacggcgggggctggaagctggagggcgagtggaaggagggggaggaggtccaggtgctcgccctggagcccggcaagaacccccgcgccgtccagaccaagcccgggatcttcaagaccaacacgggcaccatcggggcggtgagcctggacttctcccccggcaccagcggctcccccatcgtggaccggaaggggaaggtcgtgggcctctacgggaacggcgtggtcacccgcagcggcgcctacgtgtccgccatcgcccagacggagaagtccatcgaggacaaccccgagatcgaggacgacatcttccggaagaagcgcctgaccatcatggacctgcaccccggggcgggcaagaccaagcggtacctccccgccatcgtgcgcgaggccatcaagcgggggctgcgcaccctgatcctggccccgacgcgcgtcgtggccgcggagatggaggaggccctccggggcctgcccatccgctaccagacccccgccatcaagaccgagcacaccgggcgggagatcgtggacctgatgtgccacgccacgttcaccatgcgcctcctgagccccgtccgggtgccgaactacaacctgatcatcatggacgaggcccacttcaccgaccccgcgtccatcgccgcccgcggctacatcagcacccgggtggagatgggcgaggccgccgggatcttcatgacggcgacgccgcccggctcccgcgacccgttcccccagagcaacgcccccatcatggacgaggagcgggagatccccgagcgctcctggaacagcgggcacgagtgggtcaccgacttcaagggcaagaccgtgtggttcgtgccgtccatcaaggccgggaacgacatcgccgcgtgcctccggaagaacggcaagaaggtcatccagctgagccgcaagacgttcgactccgagtacgtgaagacccgggccaacgactgggacttcgtggtcaccaccgacatcagcgagatgggcgccaacttcaaggccgagcgcgtgatcgacccccggcgctgcatgaagcccgtgatcctgacggacggggaggagcgggtcatcctcgccggccccatgccggtgacccactccagcgcggcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcgcgcaagaccttcgtcgacctgatgcggcgcggcgacctccccgtgtggctggcctacaaggtggccgccgaggggatcaactacgccgaccggaagtggtgcttcgacggcatcaagaacaaccagatcctggaggagaacatggaggtcgagatctggacgaaggagggggagcgcaagaagctcaagccgcggtggctggacgcgcgcatctacagcgaccccctggccctcaaggagttcaaggagttcgccgccggccggaagtccctgaccctgaacctcatcaccgagatgggccgcctgcccaccttcatgacgcagaaggcgcggaacgccctggacaacctcgccgtgctgcacaccgccgaggccgggggccgcgcgtacaaccacgccctgagcgagctccccgagaccctggagaccctgctcctgctgacgctcctggccaccgtcaccgggggcatcttcctgttcctcatgtccggcaaggggatcggcaagatgaccctggggatgtgctgcatcatcaccgccagcatcctgctctggtacgcccagatccagccgcactggatcgcggcctccatcatcctggagttcttcctgatcgtgctcctgatccccgagcccgagaagcagcggacgccccaggacaaccagctgacctacgtggtcatcgccatcctcaccgtggtggccgccaccatggcgaacgagatgggcttcctggagaagacgaagaaggacctggggctcggcagcatcaccacccaggagagcgagtccaacatcctggacatcgacctgcgcccggccagcgcctggaccctctacgccgtcgccacgaccttcgtgacccccatgctgcggcactccatcgagaacagctccgtgaacgtcagcctgaccgcgatcgccaaccaggccacggtgctcatgggcctggggaagggctggcccctgtccaagatggacatcggggtgcccctcctggccatcggctgctacagccaggtcaacccgatcaccctgaccgcggccctcctgctgctcgtggcccactacgccatcatcgggcccggcctgcaggccaaggcgacccgcgaggcccagaagcgggccgccgccggcatcatgaagaaccccacggtggacgggatcaccgtcatcgacctggagcccatcccgtacgaccccaagttcgagaagcagctcggccaggtgatgctgctgatcctctgcgtgacccaggtcctgatgatgcgcaccacgtgggcgctgtgcgaggccctcaccctggccaccgggcccatctccaccctgtgggagggcaaccccgggcggttctggaacacgaccatcgccgtgagcatggccaacatcttccgcggctcctacctcgcgggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtggaccggaccctcgccaaggaggggatcaagcgcggcgagacggaccaccacgcggtctcccgggggagcgccaagctgcgctggttcgtggagcggaacatggtgaccccggagggcaaggtcgtggacctgggctgcgggcgcggcgggtggtcctactactgcggcgggctcaagaacgtgcgggaggtcaagggcctgaccaagggcgggcccggccacgaggagcccatccccatgagcacctacgggtggaacctggtgcgcctccagagcggcgtggacgtcttcttcacgccgcccgagaagtgcgacaccctgctgtgcgacatcggggagtccagccccaaccccaccatcgaggccggccggaccctccgcgtgctgaacctggtggagaactggctcaacaacaacacccagttctgcatcaaggtcctgaacccgtacatgccctccgtgatcgagaagatggaggccctgcagcggcagtacggcggggccctcgtgcgcaaccccctgagccggaactccacgcacgagatgtactgggtcagcaacgcgaccggcaacatcgtgtccagcgtgaacatgatctcccgcatgctgatcaaccggttcaccatgaagcacaagaaggccacctacgagccggacgtcgacctggggagcggcacgcgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagaccgggagcgcctccagcatggtgaacggcgtggtccgcctgctgacgaagccctgggacgtggtgccgatggtcacccagatggccatgaccgacaccacgcccttcgggcagcagcgcgtgttcaaggagaaggtggacacccggacccaggagcccaaggagggcaccaagaagctcatgaagatcacggcggagtggctgtggaaggagctgggcaagaagaagacgccccgcatgtgcacccgggaggagttcacccgcaaggtccggtccaacgccgccctcggggccatcttcacggacgagaacaagtggaagtccgcccgcgaggcggtggaggacggccggttctgggagctggtggaccgcgagcggaacctgcacctcgaggggaagtgcgagacctgcgtctacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggggaacagcctctccggcgtggagggggagggcctgcaccgcctgggctacatcctccgggacgtcgggaagaaggagggcggggccatgtacgccgacgacaccgccggctgggacacccgcatcacgctggaggacctgaagaacgaggagatggtgaccaaccacatgaagggggagcacaagaagctcgccgaggcgatcttcaagctgacctaccagaacaaggtggtccgggtgcagcgcccgacgccccggggcacggtgatggacatcatcagccgccgggaccagcgcggctccgggcaggtcggcacctacgggctgaacaccttcaccaacatggaggcccagctcatccgccagatggagggcgagggcatcttcaagagcatccagcacctgacggccaccgaggagatcgccgtgcagaactggctggcccgggtggggcgcgagcggctctcccgcatggcgatcagcggcgacgactgcgtcgtgaagcccatcgacgaccggttcgcctccgccctgaccgccctgaacgacatggggaaggtgcgcaaggacatccagcagtgggagcccagccggggctggaacgactggacccaggtcccgttctgctcccaccacttccacgagctcgtgatgaaggacgggcgcgtgctggtcgtgccctgccggaaccaggacgagctgatcggccgcgcccggatcagccagggcgcggggtggtccctcaaggagacggcctgcctgggcaagagctacgcccagatgtggaccctgatgtacttccaccgccgggacctccgcctggccgccaacgcgatctgctccgccgtgcccagccactgggtccccacctcccggaccacctggagcatccacgccaagcacgagtggatgacgaccgaggacatgctggccgtgtggaaccgcgtgtggatccaggagaacccgtggatggaggacaagacccccgtcgagtcctgggaggaggtgccctacctcgggaagcgggaggaccagtggtgcggcagcctgatcgggctgaccagccgcgcgacgtgggccaagaacatccaggccgccatcaaccaggtgcggtccctcatcggcaacgaggagtacaccgactacatgcccagcatgaagcgcttccgccgggaggaggaggaggccggcgtcctgtggtga

SEQ ID NO: 9275 - RNA, 9876 nt, synthetic construct
  misc_feature 1..9876: note = derived and/or modified CDS sequence (opt1) from DENV-2__EU482756__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagtacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccttcgtgaccccgatgctgcgccactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacgtacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacggcggggcgctggtccggaaccccctgtcccgcaacagcacccacgagatgtactgggtgtccaacgccaccggcaacatcgtgagctccgtcaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggcccaccccgcgcggcaccgtcatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtgcagaactggctcgcgcgcgtcgggcgggagcgcctgagccggatggccatctccggcgacgactgcgtggtgaagcccatcgacgaccgcttcgccagcgccctgacggccctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtcccctcccactgggtgcccaccagccgcacgacctggtccatccacgccaagcacgagtggatgaccaccgaggacatgctcgcggtgtggaaccgggtctggatccaggagaacccctggatggaggacaagacgccggtggagagctgggaggaggtgccctacctggggaagcgcgaggaccagtggtgcggctccctgatcgggctcaccagccgggccacctgggccaagaacatccagaccgccatcaaccaggtccgcagcctgatcggcaacgaggagtacacggactacatgccctccatgaagcgcttccggcgcgaggaggaggaggccggcgtgctgtggtga

SEQ ID NO: 9276 - RNA, 9876 nt, synthetic construct
  misc_feature 1..9876: note = derived and/or modified CDS sequence (opt1) from DENV-2__EU482757__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcatcggcacgaagcacgcgatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgccgcgttcaaggtgcgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtcctcaagatcgtgcgcaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtcggcatggtgagcatcctggcctccagcctgctcaagaacgacatccccatgacggggcccctggtggcgggcgggctgctcaccgtctgctacgtgctgaccggccggagcgccgacctggagctcgagcgcgccgccgacgtgaagtgggaggaccaggccgagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgcggccgcctggtacctctgggaggtcaagaagcagcgcgccggcgtgctgtgggacgtgcccagcccgccgcccgtcgagaaggccgagctggaggacggggcgtaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggccctggagcccggcaagaacccccgcgcggtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgccatcgcgcagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcaccctgatcctcgccccgacgcgcgtggtggcggccgagatggaggaggccctgcggggcctgcccatccgctaccagacccccgccatcaagaccgagcacaccgggcgggagatcgtcgacctcatgtgccacgccacgttcaccatgcgcctgctgagccccgtgcgggtgccgaactacaacctcatcatcatggacgaggcgcacttcaccgaccccgcctccatcgccgcccgcggctacatcagcacccgggtcgagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggccgagcgcgtgatcgacccccggcgctgcatgaagcccgtcatcctcacggacggggaggagcgggtgatcctggcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtcgacgcgatcgacggcgagtaccgcctgcgcggggaggcccgcaagaccttcgtggacctcatgcggcgcggcgacctgcccgtgtggctggcctacaaggtcgccgccgaggggatcaactacgcggaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccaccttcatgacgcagaaggcccggaacgccctcgacaacctggccgtgctgcacaccgccgaggccgggggccgcgcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgccagcatcctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgaccatggccaacgagatgggcttcctggagaagacgaagaaggacctcgggctgggcagcatcaccacccaggagagcgagtccaacatcctggacatcgacctccgcccggccagcgcctggaccctgtacgccgtggcgacgaccttcgtgacccccatgctgcggcactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaacccgatcaccctcaccgccgccctgctgctcctggtggcccactacgccatcatcgggcccggcctgcaggcgaaggccacccgcgaggcccagaagcgggccgccgcgggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgccgtgagcatggcgaacatcttccgcggctcctacctggccggcgccgggctcctgttcagcatcatgaagaacaccacctccacgcgccggggcaccgggaacatcggcgagaccctgggcgagaagtggaagtcccgcctgaacgccctcgggaagtccgagttccagatctacaagaagtccggcatccaggaggtcgaccggaccctggcgaaggaggggatcaagcgcggcgagacggaccaccacgccgtgtcccgggggagcgccaagctgcgctggttcgtggagcggaacatggtcaccccggagggcaaggtggtggacctcggctgcgggcgcggcgggtggtcctactactgcggcgggctgaagaacgtccgggaggtgaagggcctgaccaagggcgggcccggccacgaggagcccatccccatgagcacctacgggtggaacctcgtgcgcctgcagagcggcgtcgacgtgttcttcacgccgcccgagaagtgcgacaccctgctctgcgacatcggggagtccagccccaaccccaccatcgaggccggccggaccctgcgcgtgctgaacctcgtcgagaactggctgaacaacaacacccagttctgcatcaaggtgctgaacccgtacatgccctccgtgatcgagaagatggaggccctccagcggaagtacggcggggcgctggtccgcaaccccctgagccggaactccacgcacgagatgtactgggtgagcaacgccaccggcaacatcgtgtccagcgtcaacatgatctcccgcatgctgatcaaccggttcaccatgaagcacaagaaggccacctacgagccggacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccctgggacgtggtcccgatggtgacccagatggcgatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagacgccccgcatgtgcacccgggaggagttcacgcgcaaggtgcggtccaacgccgccctgggggccatcttcaccgacgagaacaagtggaagtccgcgcgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtggagggggagggcctgcaccgcctcggctacatcctgcgggacgtcagcaagaaggagggcggcgccatgtacgccgacgacaccgccgggtgggacacgcgcatcaccctggaggacctcaagaacgaggagatggtgaccaaccacatgaagggcgagcacaagaagctggcggaggccatcttcaagctgacctaccagaacaaggtcgtgcgggtgcagcgcccgacgccccgggggaccgtcatggacatcatctcccgccgggaccagcgcggcagcggccaggtggggacctacggcctcaacaccttcacgaacatggaggcccagctgatccgccagatggagggggagggcatcttcaagtccatccagcacctgaccgccaccgaggagatcgtggtccagaactggctcgcccgggtgggccgcgagcggctgagccgcatggcgatctccggggacgactgcgtggtcaagcccatcgacgaccggttcgccagcgccctgaccgccctcaacgacatgggcaaggtgcgcaaggacatccagcagtgggagccctcccgggggtggaacgactggacccaggtcccgttctgcagccaccacttccacgagctggtcatgaaggacggccgcgtgctggtggtcccctgccggaaccaggacgagctcatcgggcgcgcccggatctcccagggcgcgggctggagcctgaaggagaccgcctgcctggggaagtcctacgcccagatgtggaccctcatgtacttccaccgccgggacctgcgcctggccgccaacgcgatctgcagcgccgtgccctcccactgggtgcccaccagccggaccacgtggtccatccacgccaagcacgagtggatgaccaccgaggacatgctcgccgtctggaaccgcgtgtggatccaggagaacccgtggatggaggacaagacccccgtggagagctgggaggaggtcccctacctgggcaagcgggaggaccagtggtgcgggagcctgatcggcctcacgtcccgcgcgacctgggccaagaacatccagaccgccatcaaccaggtgcggagcctgatcgggaacgaggagtacaccgactacatgccctccatgaagcgcttccgccgggaggaggaggaggccggcgtgctgtggtga

SEQ ID NO: 9277 - RNA, 9876 nt, synthetic construct
  misc_feature 1..9876: note = derived and/or modified CDS sequence (opt1) from DENV-2__FJ906956__SS-prME
  source 1..9876: mol_type = other RNA
accgccggcgtcatcgtcatgctgatccccaccgccatggcgttccacctcaccacccggaacggggagccgcacatgatcgtgggcaagcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccgccgggagaagcgctccgtggccctggtgccccacgtcgggatgggcctcgagacccggaccgagacctggatgagctccgagggggcctggaagcacgtgcagcggatcgagacctggatcctgcggcacccgggcttcaccatcatggccgcgatcctggcctacaccatcgggaccacccacttccagcgggccctcatcttcatcctgctgaccgccgtggcgcccagcatgaccatgcggtgcatcggcatctccaaccgcgacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccggaagtactgcatcgaggccaagctgacgaacaccaccaccgagtcccggtgcccgacgcagggcgagcccagcctgaacgaggagcaggacaagcggttcatctgcaagcactccatggtggaccgcggctgggggaacggctgcggcctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccgccagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccggcaaggacagccccgtgaacatcgaggcggagccgcccttcggggactcctacatcatcatcggcgtggagccggggcagctgaagctcaactggttcaagaagggcagctccatcggccagatgttcgagacgaccatgcgcggggccaagcgcatggccatcctgggcgacaccgcctgggacttcgggagcctgggcggggtcttcacctccatcggcaaggccctccaccaggtgttcggcgcgatctacggggccgccttcagcggcgtgtcctggacgatgaagatcctgatcggggtcatcatcacctggatcggcatgaacagccggtccaccagcctgtccgtgagcctggtgctcgtcggggtggtgaccctgtacctgggcgccatggtccaggcggactccggctgcgtggtgagctggaagaacaaggagctcaagtgcgggtccggcatcttcatcacggacaacgtccacacctggaccgagcagtacaagttccagcccgagagccccagcaagctggcctccgccatccagaaggcccacgaggaggggatctgcggcatccgcagcgtgacccggctggagaacctcatgtggaagcagatcacgcccgagctgaaccacatcctgtccgagaacgaggtgaagctcaccatcatgaccggggacatccgcggcatcatgcaggccggcaagcggagcctgcgcccgcagcccaccgagctgaagtactcctggaagacgtgggggaaggcgaagatgctcagcaccgagtcccacaaccagaccttcctgatcgacggccccgagaccgccgagtgcccgaacacgaaccgggcctggaacagcctggaggtcgaggactacgggttcggcgtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggggtgctggagagcgagatggtcatccccaagaacttcgccggccccgtgtcccagcacaactaccgcccggggtaccacacgcagaccgcgggcccctggcacctcgggaagctggagatggacttcgacctgtgcgagggcaccaccgtggtcgtgacggaggactgcggcaaccgggggcccagcctccgcaccaccaccgccagcggcaagctgatcacggagtggtgctgccggtcctgcaccctgcccccgctccgctaccgcggggaggacggctgctggtacgggatggagatccgccccctgaaggagaaggaggagaacctggtgaacagcctcgtcaccgccggccacggccagatcgacaacttctccctgggggtgctgggcatggccctcttcctggaggagatgctgcggacccgcatcgggacgaagcacgcgatcctcctggtggccgtcagcttcgtgaccctgatcaccggcaacatgtccttccgggacctcgggcgcgtgatggtcatggtgggcgccaccatgacggacgacatcggcatgggggtgacctacctggccctgctcgccgcgttcaaggtccgccccaccttcgccgccggcctgctgctccggaagctgaccagcaaggagctgatgatggccacgatcgggatcgccctcctgtcccagagcaccatccccgagaccatcctggagctcaccgacgcgctggccctgggcatgatggtgctcaagatcgtgcgcaacatggagaagtaccagctggccgtcacgatcatggccatctcctgcgtgccgaacgccgtgatcctgcagaacgcgtggaaggtcagctgcaccatcctcgccgccgtgtccgtcagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccatcatggccgtggggatggtgagcatcctggcctccagcctgctcaagaacgacatccccatgacgggccccctggtcgccggcgggctgctcaccgtgtgctacgtgctgaccgggcggagcgccgacctggagctcgagcgcgccgccgacgtcaagtgggaggaccaggccgagatctccgggagctcccccatcctgagcatcaccatctccgaggacggcagcatgtccatcaagaacgaggaggaggagcagacgctgaccatcctcatccggaccgggctgctggtgatcagcggcgtgttcccggtctccatccccatcaccgcggccgcctggtacctctgggaggtgaagaagcagcgcgccggggtgctgtgggacgtccccagcccgccgcccgtggagaaggccgagctggaggacggcgcgtaccggatcaagcagcgcgggatcctcggctactcccagatcggcgccggggtgtacaaggagggcaccttccacacgatgtggcacgtcacccgcggggcggtgctgatgcaccggggcaagcggatcgagcccagctgggccgacgtgaagaaggacctgatctcctacgggggcggctggaagctcgagggggagtggaaggagggcgaggaggtccaggtgctggccctggagcccgggaagaacccccgcgcggtgcagaccaagcccggcatcttcaagaccaacacggggaccatcggcgccgtcagcctcgacttctcccccggcaccagcgggtcccccatcgtggaccggaagggcaaggtggtcgggctgtacggcaacggcgtggtgacccgcagcggggcctacgtctccgccatcgcgcagacggagaagtccatcgaggacaaccccgagatcgaggacgacatcttccggaagaagcgcctgaccatcatggacctccaccccggcgccgggaagaccaagcggtacctgcccgccatcgtgcgcgaggccatcaagcggggcctgcgcaccctgatcctcgccccgacgcgcgtggtcgcggccgagatggaggaggccctgcgggggctgcccatccgctaccagaccaccgccatcaagaccgagcacacgggccgggagatcgtggacctcatgtgccacgccaccttcaccatgcgcctgctgagccccgtgcgggtccccaactacaacctcatcatcatggacgaggcgcacttcaccgacccggcctccatcgccgcccgcggctacatcagcacgcgggtggagatgggggaggccgcgggcatcttcatgaccgccacgccgcccgggtcccgcgaccccttcccgcagagcaacgcccccatcatggacgaggagcgggagatccccgagcgctcctggaacagcggccacgagtgggtgaccgacttcaaggggaagacggtctggttcgtgccctccatcaaggccggcaacgacatcgcggcctgcctgcggaagaacggcaagcgcgtgatccagctgagccggaagaccttcgactccgagtacgtcaagacccgcgccaacgactgggacttcgtggtgaccacggacatcagcgagatgggggccaacttcaaggccgagcgggtcatcgacccgcgccggtgcatgaagcccgtgatcctcaccgacggcgaggagcgcgtgatcctggcggggcccatgcccgtcacccactccagcgccgcccagcggcgcggccgcatcgggcggaacccgaagaacgagaacgaccagtacatctacatgggcgagcccctggagaacgacgaggactgcgcccactggaaggaggccaagatgctcctggacaacatcaacacccccgagggcatcatcccctccatgttcgagccggagcgcgagaaggtggacgcgatcgacggggagtaccggctgcgcggcgaggcccggaagacgttcgtggacctcatgcgccgcggggacctgcccgtctggctggcctacaaggtggccgccgagggcatcaactacgcggaccgcaagtggtgcttcgacgggatcaagaacaaccagatcctcgaggagaacatggaggtggagatctggaccaaggagggcgagcggaagaagctgaagccccgctggctggacgcccggatctacagcgacccgctcgccctgaaggagttcaaggagttcgccgcgggccgcaagtccctgaccctcaacctgatcaccgagatggggcggctgcccacgttcatgacccagaaggcccgcaacgccctcgacaacctggccgtcctgcacaccgccgaggcgggcgggcgggcctacaaccacgccctcagcgagctgcccgagaccctggagacgctcctgctgctcaccctgctggccaccgtgaccggcggcatcttcctcttcctgatgtccgggaagggcatcgggaagatgaccctgggcatgtgctgcatcatcacggccagcatcctcctgtggtacgcgcagatccagccccactggatcgccgcctccatcatcctggagttcttcctcatcgtcctgctgatcccggagcccgagaagcagcgcacgccccaggacaaccagctcacctacgtggtgatcgccatcctgaccgtcgtggccgcgacgatggccaacgagatggggttcctggagaagaccaagaaggacctcggcctgggcagcatcaccacccaggagagcgagtccaacatcctggacatcgacctccggcccgccagcgcctggacgctgtacgccgtggcgaccaccttcgtcaccccgatgctgcgccactccatcgagaacagctccgtgaacgtgagcctcacggccatcgccaaccaggccaccgtcctgatggggctgggcaaggggtggcccctctccaagatggacatcggcgtgcccctgctggcgatcgggtgctacagccaggtgaaccccatcaccctcaccgccgccctgctgctcctggtcgcccactacgccatcatcggcccgggcctgcaggcgaaggccacgcgggaggcccagaagcgcgccgccgcggggatcatgaagaaccccaccgtggacggcatcaccgtgatcgacctcgagcccatcccctacgacccgaagttcgagaagcagctggggcaggtcatgctgctcatcctgtgcgtgacccaggtgctgatgatgcggacgacctgggccctctgcgaggccctgaccctggccaccggccccatctccacgctctgggaggggaaccccggccgcttctggaacaccaccatcgccgtcagcatggcgaacatcttccgcggctcctacctggccggggccggcctcctcttcagcatcatgaagaacaccacgaacacccggcgcgggaccggcaacatcggcgagaccctgggggagaagtggaagtcccggctgaacgccctcggcaagagcgagttccagatctacaagaagtccgggatccaggaggtggaccgcacgctggcgaaggagggcatcaagcgcggggagaccgaccaccacgccgtgagccgcggctccgccaagctgcggtggttcgtcgagcgcaacatggtgacccccgagggcaaggtggtcgacctcgggtgcggccgcggcgggtggagctactactgcggcgggctgaagaacgtgcgcgaggtgaaggggctgaccaagggcggcccggggcacgaggagcccatccccatgtccacgtacggctggaacctcgtccggctgcagagcggggtggacgtgttcttcacgccgcccgagaagtgcgacaccctgctctgcgacatcggcgagagctcccccaaccccaccatcgaggccggccgcaccctgcgggtcctgaacctcgtggagaactggctgaacaacaacacgcagttctgcatcaaggtgctgaacccctacatgcccagcgtcatcgagaagatggaggccctccagcgcaagtacgggggcgcgctggtgcggaaccccctgtcccgcaacagcacccacgagatgtactgggtgtccaacgccaccgggaacatcgtcagctccgtgaacatgatcagccggatgctgatcaaccgcttcaccatgaagcacaagaaggccacgtacgagcccgacgtggacctcggctccgggacccggaacatcggcatcgagagcgagatcccgaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtcaacggggtggtgcgcctgctcaccaagccctgggacgtcgtgcccatggtgacccagatggcgatgacggacaccaccccgttcggccagcagcgggtcttcaaggagaaggtggacacccgcacgcaggagcccaaggagggcaccaagaagctgatgaagatcaccgccgagtggctgtggaaggagctcgggaagaagaagacgccccggatgtgcacgcgcgaggagttcacccggaaggtgcgcagcaacgccgccctgggcgccatcttcaccgacgagaacaagtggaagtccgcgcgggaggccgtcgaggacgggcgcttctgggagctggtggaccgggagcgcaacctccacctggagggcaagtgcgagacctgcgtgtacaacatgatggggaagcgggagaagaagctgggcgagttcggcaaggccaaggggagccgcgccatctggtacatgtggctcggcgcgcggttcctggagttcgaggccctggggttcctcaacgaggaccactggttctcccgcggcaacagcctgagcggggtcgagggcgagggcctgcaccggctcgggtacatcctgcgcgacgtgggcaagaaggagggcggcgccatgtacgccgacgacacggccgggtgggacacccggatcaccctggaggacctcaagaacgaggagatggtcaccaaccacatgaagggcgagcacaagaagctggcggaggccatcttcaagctgacgtaccagaacaaggtggtgcgcgtccagcggcccaccccgcgcggcaccgtgatggacatcatctcccggcgcgaccagcgcgggagcggccaggtggggacctacggcctcaacacgttcaccaacatggaggcccagctgatccggcagatggagggcgaggggatcttcaagtccatccagcacctgaccgccaccgaggagatcgccgtccagaactggctcgcgcgcgtgggccgggagcgcctgagccggatggccatctccggggacgactgcgtggtcaagcccatcgacgaccgcttcgccagcgccctgacggccctcaacgacatgggcaaggtgcggaaggacatccagcagtgggagccctcccgcgggtggaacgactggacccaggtgcccttctgcagccaccacttccacgagctggtcatgaaggacggccgggtgctggtggtcccgtgccgcaaccaggacgagctcatcggccgggcgcgcatctcccagggggccggctggagcctgaaggagaccgcctgcctggggaagtcctacgcccagatgtggaccctcatgtacttccaccggcgcgacctgcggctggccgcgaacgccatctgcagcgccgtgccctcccactgggtgcccaccagccgcacgacctggtccatccacgccaaccacgagtggatgaccaccgaggacatgctcgcggtctggaaccgggtgtggatccaggagaacccctggatggaggacaagacgccggtggagagctgggaggaggtcccctacctgggcaagcgcgaggaccagtggtgcgggtccctgatcggcctcaccagccgggccacctgggccaagaacatccagaccgccatcaaccaggtgcgcagcctgatcggcaacgaggagtacacggactacatgccctccatgaagcgcttccggcgcgaggaggaggaggccggggtgctgtggtga

SEQ ID NO: 9278 - RNA, 9876 nt, synthetic construct
  misc_feature 1..9876: note = derived and/or modified CDS sequence (opt1) from DENV-2__EU482759__SS-prME
  source 1..9876: mol_type = other RNA
accgccggcgtgatcgtcatgctgatccccaccgccatggcgttccacctcaccacccggaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcggcacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgcggggccatcaagcgcggcctgcgcaccctgatcctcgccccgacgcgggtggtggcggccgagatggaggaggccctgcgcgggctgcccatccggtaccagaccaccgccatcaagaccgagcacacgggccgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggggaggccgcgggcatcttcatgaccgccacgccgcccgggtcccgggaccccttcccgcagagcaacgcccccatcatggacgaggagcgcgagatccccgagcggtcctggaacagcggccacgagtgggtgaccgacttcaaggggaagacggtgtggttcgtcccctccatcaaggccggcaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggggccaacttcaaggccgagcgggtgatcgacccgcgccggtgcatgaagcccgtcatcctcaccgacggcgaggagcgcgtgatcctggcggggcccatgcccgtgacccactccagcgccgcccagcggcgcggccgcatcgggcggaacccgaagaacgagaacgaccagtacatctacatgggcgagcccctggagaacgacgaggactgcgcccactggaaggaggccaagatgctcctggacaacatcaacacccccgagggcatcatcccctccatgttcgagccggagcgcgagaaggtcgacgcgatcgacggggagtaccggctgcgcggcgaggcccggaagacgttcgtggacctcatgcgccgcggggacctgcccgtgtggctggcctacaaggtcgccgccgagggcatcaactacgcggaccgcaagtggtgcttcgacgggatcaagaacaaccagatcctcgaggagaacatggaggtggagatctggaccaaggagggcgagcggaagaagctgaagccccgctggctggacgcccggatctacagcgacccgctcgccctgaaggagttcaaggagttcgccgcgggccgcaagtccctgaccctcaacctgatcaccgagatggggcggctgcccacgttcatgacccagaaggcccgcaacgccctcgacaacctggccgtgctgcacaccgccgaggcgggcgggcgggcctacaaccacgccctcagcgagctgcccgagaccctggagacgctcctgctgctcaccctgctggccaccgtcaccggcggcatcttcctcttcctgatgtccgggaagggcatcgggaagatgaccctgggcatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatggggttcctggagaagaccaagaaggacctcggcctgggcagcatcaccacccaggagagcgagtccaacatcctggacatcgacctccggcccgccagcgcctggacgctgtacgccgtggcgaccaccttcgtgaccccgatgctgcgccactccatcgagaacagctccgtcaacgtgagcctcacggccatcgccaaccaggccaccgtgctgatggggctgggcaaggggtggcccctctccaagatggacatcggcgtccccctgctggcgatcgggtgctacagccaggtgaaccccatcaccctcaccgccgccctgctgctcctggtggcccactacgccatcatcggcccgggcctgcaggcgaaggccacgcgggaggcccagaagcgcgccgccgcggggatcatgaagaaccccaccgtcgacggcatcaccgtgatcgacctcgagcccatcccctacgacccgaagttcgagaagcagctggggcaggtcatgctgctcatcctgtgcgtcacccaggtgctgatgatgcggacgacctgggccctctgcgaggccctgaccctggccaccggccccatctccacgctctgggaggggaaccccggccgcttctggaacaccaccatcgccgtgagcatggcgaacatcttccgcggctcctacctggccggggccggcctcctgttcagcatcatgaagaacaccacgaacacccggcgcgggaccggcaacatcggcgagaccctgggggagaagtggaagtcccggctgaacgccctcggcaagagcgagttccagatctacaagaagtccgggatccaggaggtcgaccgcacgctggcgaaggagggcatcaagcgcggggagaccgaccaccacgccgtgagccgcggctccgccaagctgcggtggttcgtggagcgcaacatggtcacccccgagggcaaggtggtggacctcgggtgcggccgcgggggctggagctactactgcgggggcctgaagaacgtccgcgaggtgaagggcctgaccaagggcggcccggggcacgaggagcccatccccatgtccacgtacggctggaacctcgtgcggctgcagagcggggtcgacgtgttcttcacgccgcccgagaagtgcgacaccctgctctgcgacatcggcgagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacgggggcgcgctggtccggaaccccctgtcccgcaacagcacccacgagatgtactgggtgtccaacgccaccgggaacatcgtgagctccgtcaacatgatcagccggatgctgatcaaccgcttcaccatgaagcacaagaaggccacgtacgagcccgacgtggacctcggctccgggacccggaacatcggcatcgagagcgagatcccgaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtcgtgcgcctgctcaccaagccctgggacgtggtccccatggtgacccagatggcgatgacggacaccaccccgttcggccagcagcgggtgttcaaggagaaggtcgacacccgcacgcaggagcccaaggagggcaccaagaagctgatgaagatcaccgccgagtggctgtggaaggagctcgggaagaagaagacgccccggatgtgcacgcgcgaggagttcacccggaaggtgcgcagcaacgccgccctgggcgccatcttcaccgacgagaacaagtggaagtccgcgcgggaggccgtggaggacgggcgcttctgggagctggtcgaccgggagcgcaacctccacctggagggcaagtgcgagacctgcgtgtacaacatgatggggaagcgggagaagaagctgggcgagttcggcaaggccaaggggagccgcgccatctggtacatgtggctcggcgcgcggttcctggagttcgaggccctggggttcctcaacgaggaccactggttctcccgcggcaacagcctgagcggggtggagggcgagggcctgcaccggctcgggtacatcctgcgcgacgtcggcaagaaggagggcggcgccatgtacgccgacgacacggccgggtgggacacccggatcaccctggaggacctcaagaacgaggagatggtgaccaaccacatgaagggcgagcacaagaagctggcggaggccatcttcaagctgacgtaccagaacaaggtcgtgcgcgtgcagcggcccaccccgcgcggcaccgtcatggacatcatctcccggcgcgaccagcgcgggagcggccaggtggggacctacggcctcaacacgttcaccaacatggaggcccagctgatccggcagatggagggcgaggggatcttcaagtccatccagcacctgaccgccaccgaggagatcgccgtgcagaactggctcgcgcgcgtcggccgggagcgcctgagccggatggccatctccggggacgactgcgtggtgaagcccatcgacgaccgcttcgccagcgccctgacggccctcaacgacatgggcaaggtccggaaggacatccagcagtgggagccctcccgcgggtggaacgactggacccaggtgcccttctgcagccaccacttccacgagctggtgatgaaggacggccgggtcctggtggtgccgtgccgcaaccaggacgagctcatcggccgggcgcgcatctcccagggggccggctggagcctgaaggagaccgcctgcctggggaagtcctacgcccagatgtggaccctcatgtacttccaccggcgcgacctgcggctggccgcgaacgccatctgcagcgccgtcccctcccactgggtgcccaccagccgcacgacctggtccatccacgccaagcacgagtggatgaccaccgaggacatgctcgcggtgtggaaccgggtctggatccaggagaacccctggatggaggacaagacgccggtggagagctgggaggaggtgccctacctgggcaagcgcgaggaccagtggtgcgggtccctgatcggcctcaccagccgggccacctgggccaagaacatccagaccgccatcaaccaggtccgcagcctgatcggcaacgaggagtacacggactacatgccctccatgaagcgcttccggcgcgaggaggaggaggccggggtgctgtggtga

SEQ ID NO: 9279 - RNA, 9876 nt, synthetic construct
  misc_feature 1..9876: note = derived and/or modified CDS sequence (opt1) from DENV-2__EU482760__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcgccaccaccggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcacgatcatggcggccatcctggcctacaccatcgggaccacccacttccagcgggccctcatcttcatcctgctgacggcggtggcccccagcatgaccatgcgctgcatcggcatctccaaccgggacttcgtcgagggcgtgagcgggggctcctgggtggacatcgtcctcgagcacgggagctgcgtgaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcgggctgttcggcaagggcgggatcgtcacgtgcgccatgttcacgtgcaagaagaacatggagggcaaggtggtgcagcccgagaacctggagtacaccatcgtcatcacgccccacagcggggaggagcacgccgtgggcaacgacacggggaagcacggcaaggagatcaagatcaccccgcagtccagcatcaccgaggccgagctgaccgggtacggcaccgtgacgatggagtgcagcccccgcaccggcctcgacttcaacgagatggtcctgctgcagatggaggacaaggcctggctcgtgcaccggcagtggttcctggacctgcccctcccctggctgccgggggcggacacccagggcagcaactggatccagaaggagaccctggtgacgttcaagaacccccacgccaagaagcaggacgtcgtggtcctcgggtcccaggagggcgccatgcacaccgccctgaccggggccaccgagatccagatgagcagcggcaacctcctgttcacgggccacctgaagtgccgcctgcggatggacaagctccagctgaaggggatgtcctacagcatgtgcaccggcaagttcaagatcgtgaaggagatcgcggagacccagcacgggaccatcgtgatccgcgtccagtacgagggcgacggctccccctgcaagatccccttcgagatcacggacctggagaagcggcacgtgctcgggcgcctgatcaccgtgaacccgatcgtcaccgagaaggacagccccgtgaacatcgaggccgagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtcttcacctccatcgggaaggcgctccaccaggtgttcggggccatctacggcgccgccttcagcggggtgtcctggaccatgaagatcctgatcggcgtcatcatcacgtggatcgggatgaacagccgctccaccagcctgtccgtgagcctggtgctcgtcggcgtggtgaccctgtacctgggggcgatggtccaggccgactccggctgcgtggtgagctggaagaacaaggagctcaagtgcggctccgggatcttcatcaccgacaacgtccacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtgaagctcacgatcatgaccggcgacatccgggggatcatgcaggcgggcaagcgcagcctgcggccgcagcccaccgagctgaagtactcctggaagacctggggcaaggccaagatgctcagcacggagtcccacaaccagaccttcctgatcgacgggcccgagaccgccgagtgcccgaacaccaaccgcgcctggaacagcctggaggtcgaggactacggcttcggggtgttcacgaccaacatctggctcaagctgcgggagaagcaggacgtgttctgcgactccaagctgatgagcgccgcgatcaaggacaaccgcgccgtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgcggggcccgtctcccagcacaactaccggccgggctaccacacccagacggccgggccctggcacctcggcaagctggagatggacttcgacctgtgcgaggggaccaccgtggtggtcaccgaggactgcggcaaccgcggccccagcctccggacgaccaccgccagcgggaagctgatcaccgagtggtgctgccgctcctgcacgctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctgttcctggaggagatgctgcgcacccggatcggcaccaagcacgccatcctcctggtggccgtgagcttcgtcacgctgatcaccgggaacatgtccttccgcgacctcggccgcgtgatggtgatggtcggggccaccatgaccgacgacatcggcatgggcgtgacgtacctggccctgctcgcggccttcaaggtgcggcccaccttcgccgccgggctgctgctccgcaagctgaccagcaaggagctgatgatggccaccatcggcatcgcgctcctgtcccagagcacgatccccgagaccatcctggagctcaccgacgccctggccctggggatgatggtcctcaagatcgtgcggaacatggagaagtaccagctggccgtgaccatcatggccatctcctgcgtcccgaacgcggtgatcctgcagaacgcctggaaggtgagctgcacgatcctcgccgccgtctccgtgagccccctgctgctcacctccagccagcagaaggcggactggatccccctggccctgaccatcaagggcctcaaccccaccgccatcttcctgacgaccctgtcccgcaccagcaagaagcggtcctggccgctcaacgaggccatcatggccgtcggcatggtgagcatcctggcgtccagcctgctcaagaacgacatccccatgaccgggcccctggtggccggcgggctgctcacggtctgctacgtgctgaccggccgcagcgccgacctggagctcgagcgggccgccgacgtgaagtgggaggaccaggcggagatctccgggagctcccccatcctgagcatcaccatctccgaggacggcagcatgtccatcaagaacgaggaggaggagcagaccctgacgatcctcatccgcaccggcctgctggtcatcagcggggtgttcccggtgtccatccccatcaccgccgccgcctggtacctctgggaggtcaagaagcagcgggccggcgtgctgtgggacgtgcccagcccgccgcccgtcgagaaggcggagctggaggacggggcctaccgcatcaagcagcggggcatcctcgggtactcccagatcggcgccggcgtgtacaaggaggggaccttccacaccatgtggcacgtgacgcgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggcgctggagcccggcaagaacccccgggccgtgcagaccaagcccgggatcttcaagaccaacaccggcacgatcggggccgtgagcctcgacttctcccccggcaccagcggctcccccatcgtcgaccgcaaggggaaggtggtgggcctgtacgggaacggcgtcgtgacccggagcggcgcctacgtgtccgcgatcgcccagaccgagaagtccatcgaggacaaccccgagatcgaggacgacatcttccgcaagaagcggctgacgatcatggacctccaccccggggccggcaagaccaagcgctacctgcccgccatcgtccgggaggccatcaagcgcgggctgcgcaccctgatcctcgcgccgacccgggtggtggccgccgagatggaggaggccctgcgcggcctgcccatccggtaccagacgaccgccatcaagaccgagcacaccgggcgcgagatcgtcgacctcatgtgccacgcgacgttcaccatgcggctgctgagccccgtgcgcgtgcccaactacaacctcatcatcatggacgaggcccacttcaccgacccggcctccatcgccgcccggggctacatcagcacccgcgtcgagatgggcgaggcggccgggatcttcatgacggccacgccgcccggctcccgggaccccttcccgcagagcaacgcccccatcatggacgaggagcgcgagatccccgagcggtcctggaacagcgggcacgagtgggtgaccgacttcaagggcaagaccgtgtggttcgtcccctccatcaaggcggggaacgacatcgccgcctgcctgcgcaagaacggcaagaaggtgatccagctgagccggaagacgttcgactccgagtacgtgaagacccgcgccaacgactgggacttcgtcgtgaccaccgacatcagcgagatgggcgccaacttcaaggcggagcgggtgatcgacccgcgccggtgcatgaagcccgtcatcctcacggacggggaggagcgcgtgatcctggccggccccatgcccgtgacccactccagcgccgcccagcggcgcgggcgcatcggccggaacccgaagaacgagaacgaccagtacatctacatgggggagcccctggagaacgacgaggactgcgcccactggaaggaggcgaagatgctcctggacaacatcaacacccccgagggcatcatcccctccatgttcgagccggagcgcgagaaggtcgacgccatcgacggcgagtaccggctgcgcggggaggcccggaagaccttcgtggacctcatgcgccggggcgacctgcccgtgtggctggcctacaaggtcgccgcggaggggatcaactacgccgaccgcaagtggtgcttcgacggcatcaagaacaaccagatcctcgaggagaacatggaggtggagatctggacgaaggagggggagcggaagaagctgaagccccgctggctggacgcccggatctacagcgacccgctcgccctgaaggagttcaaggagttcgcggccggccgcaagtccctgaccctcaacctgatcaccgagatgggccggctgcccaccttcatgacgcagaaggcccgcaacgccctcgacaacctggccgtgctgcacaccgcggaggccgggggccgggcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgcgagcatcctcctgtggtacgcccagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgcggccaccatggccaacgagatgggcttcctggagaagacgaagaaggacctcgggctgggcagcatcaccacccaggagagcgagtccaacatcctggacatcgacctccggcccgccagcgcctggaccctgtacgcggtggccacgaccttcgtgaccccgatgctgcgccactccatcgagaacagctccgtcaacgtgagcctcaccgccatcgccaaccaggcgacggtgctgatgggcctggggaagggctggcccctctccaagatggacatcggggtccccctgctggccatcggctgctacagccaggtgaaccccatcaccctcaccgccgccctgctgctcctggtggcccactacgcgatcatcgggccgggcctgcaggccaaggccacccgggaggcccagaagcgcgccgcggccggcatcatgaagaaccccacggtcgacgggatcaccgtgatcgacctcgagcccatcccctacgacccgaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaaccccgggcgcttctggaacacgaccatcgcggtgagcatggccaacatcttccgcggctcctacctggccggcgccgggctcctcttcagcatcatgaagaacaccaccaacacgcggcgcggcaccgggaacatcggcgagaccctgggcgagaagtggaagtcccggctgaacgcgctcggcaagagcgagttccagatctacaagaagtccggcatccaggaggtcgaccgcaccctggccaaggaggggatcaagcggggcgagacggaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacctacgggtggaacctcgtgcggctgcagagcggcgtcgacgtgttcttcacgcccccggagaagtgcgacaccctgctctgcgacatcggggagagctcccccaaccccaccatcgaggccggccgcaccctgcgggtgctgaacctcgtcgagaactggctgaacaacaacacccagttctgcatcaaggtgctgaacccctacatgccgagcgtgatcgagaagatggaggcgctccagcgcaagtacggcggggccctggtccggaaccccctgtcccgcaacagcacgcacgagatgtactgggtgtccaacgccaccggcaacatcgtgagctccgtcaacatgatcagccggatgctgatcaaccgcttcaccatgaagcacaagaaggccacctacgagcccgacgtggacctcgggtccggcacgcggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagaccaagcagacggggtccgcgagctccatggtgaacggcgtcgtgcgcctgctcaccaagccctgggacgtggtccccatggtgacccagatggccatgaccgacacgaccccgttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgcagcaacgccgccctgggggcgatcttcaccgacgagaacaagtggaagtccgcccgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacaccgcgggctgggacacgcggatcaccctggaggacctcaagaacgaggagatggtgaccaaccacatgaagggggagcacaagaagctggccgaggccatcttcaagctgacctaccagaacaaggtcgtgcgcgtgcagcggcccacgccgcgcggcaccgtcatggacatcatctcccggcgcgaccagcgcggcagcggccaggtgggcacctacgggctcaacaccttcacgaacatggaggcccagctgatccggcagatggagggcgagggcatcttcaagtccatccagcacctgaccgccaccgaggagatcgcggtgcagaactggctcgcccgcgtcgggcgggagcgcctgagccggatggccatctccggcgacgactgcgtggtgaagcccatcgacgaccgcttcgccagcgccctgaccgcgctcaacgacatggggaagatccggaaggacatccagcagtgggagccctcccgcggctggaacgactggacgcaggtccccttctgcagccaccacttccacgagctggtgatgaaggacgggcgggtgctggtcgtgccgtgccgcaaccaggacgagctcatcggccgggcccgcatctcccagggcgccgggtggagcctgaaggagaccgcctgcctgggcaagtcctacgcccagatgtggaccctcatgtacttccaccggcgcgacctgcggctggcggccaacgccatctgcagcgccgtgccctcccactgggtccccaccagccgcaccacgtggtccatccacgcgaagcacgagtggatgaccaccgaggacatgctcgccgtgtggaaccgggtgtggatccaggagaacccctggatggaggacaagaccccggtcgagagctgggaggaggtgccctacctggggaagcgcgaggaccagtggtgcggctccctgatcgggctcacgagccgggccacctgggccaagaacatccagaccgccatcaaccaggtgcgcagcctgatcggcaacgaggagtacaccgactacatgccctccatgaagcgcttccggcgcgaggaggaggaggcgggcgtcctgtggtga

SEQ ID NO: 9280 - RNA, 9876 nt, synthetic construct
  misc_feature 1..9876: note = derived and/or modified CDS sequence (opt1) from DENV-2__EU482762__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgctactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccttcgtgaccccgatgctgcgccactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacgtacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacggcggggcgctggtccggaaccccctgtcccgcaacagcacccacgagatgtactgggtgtccaacgccaccggcaacatcgtgagctccgtcaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggcccaccccgcgcggcaccgtcatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtgcagaactggctcgcgcgcgtcgggcgggagcgcctgagccggatggccatctccggcgacgactgcgtggtgaagcccatcgacgaccgcttcgccagcgccctgacggccctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtcccctcccactgggtgcccaccagccgcacgacctggtccatccacgccaagcacgagtggatgaccaccgaggacatgctcgcggtgtggaaccgggtctggatccaggagaacccctggatggaggacaagacgccggtggagagctgggaggaggtgccctacctggggaagcgcgaggaccagtggtgcggctccctgatcgggctcaccagccgggccacctgggccaagaacatccagaccgccatcaaccaggtccgcagcctgatcggcaacgaggagtacacggactacatgccctccatgaagcgcttccggcgcgaggaggaggaggccggcgtgctgtggtga

SEQ ID NO: 9281 - RNA, 9876 nt, synthetic construct
  misc_feature 1..9876: note = derived and/or modified CDS sequence (opt1) from DENV-2__EU482763__SS-prME
  source 1..9876: mol_type = other RNA
accgccggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtcttcacctccatcgggaaggccctccaccaggtgttcggggcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacaccgaccgcaagtggtgcttcgacggcatcaagaacaaccagatcctcgaggagaacatggaggtggagatctggaccaaggagggggagcggaagaagctgaagccccgctggctggacgcgcggatctacagcgacccgctcgccctgaaggagttcaaggagttcgccgccggccgcaagtccctgaccctcaacctgatcacggagatgggccggctgcccaccttcatgacccagaaggcgcgcaacgccctcgacaacctggccgtgctgcacaccgccgaggccgggggccgggcgtacaaccacgccctcagcgagctgcccgagacgctggagaccctcctgctgctcaccctgctggccaccgtcaccgggggcatcttcctcttcctgatgtccggcaaggggatcggcaagatgacgctggggatgtgctgcatcatcaccgccagcatcctcctgtggtacgcccagatccagccccactggatcgcggcctccatcatcctggagttcttcctcatcgtgctgctgatcccggagcccgagaagcagcgcacgccccaggacaaccagctcacctacgtcgtgatcgccatcctgacggtggtcgccgccaccatggcgaacgagatgggcttcctggagaagaccaagaaggacctcgggctgggcagcatcaccacgcaggagagcgagtccaacatcctggacatcgacctccggcccgccagcgcctggaccctgtacgccgtggccaccaccttcgtgacgccgatgctgcgccactccatcgagaacagctccgtcaacgtgagcctcaccgcgatcgccaaccaggccaccgtgctgatgggcctggggaagggctggcccctctccaagatggacatcggggtccccctgctggccatcggctgctacagccaggtgaaccccatcaccctcacggcggccctgctgctcctggtggcccactacgccatcatcgggccgggcctgcaggccaaggcgacccgggaggcccagaagcgcgccgccgccggcatcatgaagaaccccaccgtcgacgggatcaccgtgatcgacctcgagcccatcccctacgacccgaagttcgagaagcagctgggccaggtgatgctgctcatcctgtgcgtcacccaggtcctgatgatgcggaccacctgggcgctctgcgaggccctgaccctggccacggggcccatctccaccctctgggagggcaaccccgggcgcttctggaacaccaccatcgccgtgagcatggccaacatcttccgcggctcctacctggcgggcgccgggctcctgttcagcatcatgaagaacacgaccaacacccggcgcggcaccgggaacatcggcgagacgctgggcgagaagtggaagtcccggctgaacgccctcggcaagagcgagttccagatctacaagaagtccggcatccaggaggtcgaccgcaccctggccaaggaggggatcaagcggggcgagaccgaccaccacgcggtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgacgaagggcgggccgggccacgaggagcccatccccatgtccacctacgggtggaacctcgtgcggctgcagagcggcgtcgacgtgttcttcacgccgcccgagaagtgcgacaccctgctctgcgacatcggggagagctcccccaaccccaccatcgaggccggccgcacgctgcgggtgctgaacctcgtcgagaactggctgaacaacaacacccagttctgcatcaaggtgctgaacccctacatgcccagcgtgatcgagaagatggaggccctccagcgcaagtacggcggggccctggtccggaaccccctgtcccgcaacagcacccacgagatgtactgggtgtccaacgcgaccggcaacatcgtgagctccgtcaacatgatcagccggatgctgatcaaccgcttcacgatgaagcacaagaaggccacctacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtgaacggcgtcgtgcgcctgctcaccaagccctgggacgtggtccccatggtgacgcagatggccatgaccgacaccaccccgttcgggcagcagcgggtgttcaaggagaaggtcgacacgcgcacccaggagcccaaggagggcaccaagaagctgatgaagatcaccgcggagtggctgtggaaggagctcggcaagaagaagacgccccggatgtgcacccgcgaggagttcacccggaaggtgcgcagcaacgccgccctgggggccatcttcaccgacgagaacaagtggaagtccgcccgggaggcggtggaggacggccgcttctgggagctggtcgaccgggagcgcaacctccacctggaggggaagtgcgagacgtgcgtgtacaacatgatgggcaagcgggagaagaagctgggggagttcggcaaggccaagggcagccgcgccatctggtacatgtggctcggggcccggttcctggagttcgaggcgctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacaccgccggctgggacacccggatcaccctggaggacctcaagaacgaggagatggtgacgaaccacatgaagggggagcacaagaagctggccgaggcgatcttcaagctgacctaccagaacaaggtcgtgcgcgtgcagcggcccaccccgcgcggcaccgtcatggacatcatctcccggcgcgaccagcgcggcagcggccaggtgggcacgtacgggctcaacaccttcaccaacatggaggcccagctgatccggcagatggagggcgagggcatcttcaagtccatccagcacctgaccgccacggaggagatcgccgtgcagaactggctcgcccgcgtcgggcgggagcgcctgagccggatggcgatctccggcgacgactgcgtggtgaagcccatcgacgaccgcttcgccagcgccctgaccgccctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcccgcatctcccagggcgcggggtggagcctgaaggagaccgcctgcctgggcaagtcctacgcccagatgtggaccctcatgtacttccaccggcgcgacctgcggctggccgccaacgcgatctgcagcgccgtcccctcccactgggtgcccacgagccgcaccacctggtccatccacgccaagcacgagtggatgaccacggaggacatgctcgccgtgtggaaccgggtctggatccaggagaacccctggatggaggacaagaccccggtggagagctgggaggaggtgccctacctggggaagcgcgaggaccagtggtgcggctccctgatcgggctcaccagccgggcgacctgggccaagaacatccagacggccatcaaccaggtccgcagcctgatcggcaacgaggagtacaccgactacatgccctccatgaagcgcttccggcgcgaggaggaggaggccggcgtgctgtggtga

SEQ ID NO: 9282 - RNA, 9876 nt, synthetic construct
  misc_feature 1..9876: note = derived and/or modified CDS sequence (opt1) from DENV-2__EU482444__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccatccaggagagcgagtccaacatcctggacatcgacctccggcccgccagcgcctggaccctgtacgccgtggcgacgaccttcgtgaccccgatgctgcgccactccatcgagaacagctccgtcaacgtgagcctcaccgccatcgccaaccaggccacggtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacccgggaggcccagaagcgcgccgccgcgggcatcatgaagaaccccacggtcgacgggatcaccgtgatcgacctcgagcccatcccctacgacccgaagttcgagaagcagctgggccaggtgatgctgctcatcctgtgcgtcacccaggtgctgatgatgcggaccacgtgggccctctgcgaggccctgaccctggccaccgggcccatctccaccctctgggagggcaaccccgggcgcttctggaacacgaccatcgccgtgagcatggcgaacatcttccgcggctcctacctggccggcgccgggctcctgttcagcatcatgaagaacaccaccaacacgcggcgcggcaccgggaacatcggcgagaccctgggcgagaagtggaagtcccggctgaacgccctcggcaagagcgagttccagatctacaagaagtccggcatccaggaggtcgaccgcaccctggcgaaggaggggatcaagcggggcgagacggaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacctacgggtggaacctcgtgcggctgcagagcggcgtcgacgtgttcttcacgcccccggagaagtgcgacaccctgctctgcgacatcggggagagctcccccaaccccaccatcgaggccggccgcaccctgcgggtgctgaacctcgtcgagaactggctgaacaacaacacccagttctgcatcaaggtgctgaacccctacatgccgagcgtgatcgagaagatggaggccctccagcgcaagtacggcggggcgctggtccggaaccccctgtcccgcaacagcacgcacgagatgtactgggtgtccaacgccaccggcaacatcgtgagctccgtcaacatgatcagccggatgctgatcaaccgcttcaccatgaagcacaagaaggccacctacgagcccgacgtggacctcgggtccggcacgcggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccctgggacgtggtccccatggtgacccagatggcgatgaccgacacgaccccgttcgggcagcagcgggtgttcaaggagaaggtcgacacccgcacccaggagcccaaggagggcacgaagaagctgatgaagatcaccgccgagtggctgtggaaggagctcggcaagaagaagacgccccggatgtgcacccgcgaggagttcacgcggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggtgatgtacgccgacgacaccgccggctgggacacgcggatcaccctggaggacctcaagaacgaggagctggtcaccaaccacatgaagggggagcacaagaagctggccgaggcgatcttcaagctcacctaccagaacaaggtggtgcgcgtccagcggcccacgccgcgcggcaccgtgatggacatcatctcccggcgcgaccagcgcggcagcgggcaggtcggcacctacgggctgaacaccttcacgaacatggaggcccagctgatccggcagatggagggcgagggcatcttcaagtccatccagcacctcaccgccaccgaggagatcgccgtccagaactggctggcccgcgtggggcgggagcgcctgagccggatggcgatctccggcgacgactgcgtggtcaagcccatcgacgaccgcttcgccagcgccctcaccgccctgaacgacatggggaaggtgcggaaggacatccagcagtgggagccctcccgcggctggaacgactggacccaggtgcccttctgcagccaccacttccacgagctggtcatgaaggacgggcgggtgctcgtggtcccgtgccgcaaccaggacgagctgatcggccgggcccgcatctcccagggcgcggggtggagcctgaaggagaccgcctgcctcggcaagtcctacgcccagatgtggaccctgatgtacttccaccggcgcgacctgcggctcgccgccaacgcgatctgcagcgccgtgccctcccactgggtgcccaccagccgcaccacgtggtccatccacgccaagcacgagtggatgaccaccgaggacatgctggccgtctggaaccgggtgtggatccaggagaacccctggatggaggacaagaccccggtggagagctgggaggaggtcccctacctggggaagcgcgaggaccagtggtgcggctccctcatcgggctgacgagccgggcgacctgggccaagaacatccagaccgccatcaaccaggtgcgcagcctgatcggcaacgaggagtacaccgactacatgccctccatgaagcgcttccggcgcgaggaggaggaggccggcgtgctctggtga

SEQ ID NO: 9283 - RNA, 9876 nt, synthetic construct
  misc_feature 1..9876: note = derived and/or modified CDS sequence (opt1) from DENV-2__EU482684__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccaccatcctggcgtacaccatcgggacgacccacttccagcgggccctcatcttcatcctgctgaccgccgtggcccccagcatgaccatgcgctgcatcggcatcagcaaccgggacttcgtcgagggcgtgagcgggggcagctgggtggacatcgtcctcgagcacgggagctgcgtgacgaccatggcgaagaacaagcccaccctggacttcgagctgatcaagaccgaggccaagcagcccgccacgctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcgggctgttcggcaagggcggcatcgtgacctgcgccatgttcacgtgcaagaagaacatggagggcaaggtggtgcagcccgagaacctggagtacacgatcgtcatcacgccccacagcggggaggagcacgcggtgggcaacgacaccgggaagcacggcaaggagatcaagatcaccccgcagtccagcatcaccgaggccgagctgacggggtacggcaccgtgaccatggagtgcagcccccggaccggcctcgacttcaacgagatggtcctgctgcagatggaggacaaggcctggctcgtgcaccggcagtggttcctggacctgcccctcccctggctgccgggggccgacacgcagggcagcaactggatccagaaggagaccctggtgaccttcaagaacccccacgccaagaagcaggacgtcgtggtcctcgggtcccaggagggcgcgatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacgcagcacgggaccatcgtgatccgcgtccagtacgagggcgacggctccccctgcaagatccccttcgagatcaccgacctggagaagcggcacgtgctcgggcgcctgatcaccgtgaacccgatcgtcacggagaaggacagccccgtgaacatcgaggccgagccgcccttcggcgactcctacatcatcatcggggtggagccgggccagctgaagctcaactggttcaagaaggggagctccatcggccagatgttcgagaccaccatgcgcggcgcgaagcggatggccatcctgggggacaccgcctgggacttcggcagcctcgggggcgtcttcacgtccatcgggaaggccctccaccaggtgttcggcgccatctacggcgcggccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccgtcgtgcaggccgactccggctgcgtggtcagctggaagaacaaggagctcaagtgcggctccgggatcttcatcaccgacaacgtgcacacctggaccgagcagtacaagttccagcccgagagccccagcaagctggcgtccgccatccagaaggcccacgaggagggcatctgcgggatccggagcgtgacgcgcctggagaacctcatgtggaagcagatcacccccgagctgaaccacatcctgtccgagaacgaggtcaagctcaccatcatgaccggcgacatcaaggggatcatgcaggccggcaagcggagcctgcgcccgcagcccacggagctgaagtactcctggaagacctggggcaaggccaagatgctcagcaccgagtcccacaaccagaccttcctgatcgacgggcccgagacggcggagtgcccgaacaccaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggccgtgcacgcggacatgggctactggatcgagtccgccctcaacgacacctggaagatggagaaggccagcttcatcgaggtgaagtcctgccactggcccaagagccacacgctgtggtccaacggcgtcctggagagcgagatgatcatccccaagaacttcgccgggcccgtgtcccagcacaactaccgcccgggctaccacacccagaccgccgggccctggcacctcggcaagctggagatggacttcgacttctgcgaggggaccacggtggtcgtgaccgaggactgcggcaaccggggccccagcctgcgcaccaccacggcgagcgggaagctcatcaccgagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacgcgcatcggcaccaagcacgccatcctgctcgtggcggtcagcttcgtgaccctgatcaccgggaacatgtccttccgggacctgggccgcgtgatggtcatggtgggggccacgatgaccgacgacatcggcatgggcgtgacctacctcgccctgctggccgccttcaaggtccgccccaccttcgcggccgggctcctgctgcggaagctcacgagcaaggagctgatgatggccaccatcggcatcgccctgctctcccagagcaccatccccgagaccatcctggagctgacggacgccctcgcgctggggatgatggtgctgaagatcgtgcgcaacatggagaagtaccagctcgccgtcaccatcatggccatctcctgcgtgccgaacgccgtgatcctgcagaacgcctggaaggtcagctgcaccatcctggcggccgtgtccgtcagccccctcctgctgacctccagccagcagaaggccgactggatccccctcgccctgacgatcaagggcctgaaccccaccgcgatcttcctcaccaccctgtcccggacgagcaagaagcgctcctggccgctgaacgaggccatcatggccgtgggcatggtgagcatcctcgcctccagcctgctgaagaacgacatccccatgaccgggcccctcgtcgccggcgggctgctgaccgtgtgctacgtgctcaccggccggagcgcggacctggagctggagcgcgccgccgacgtcaagtgggaggaccaggccgagatctccgggagctcccccatcctcagcatcacgatctccgaggacggcagcatgtccatcaagaacgaggaggaggagcagaccctgaccatcctgatccggaccggcctcctggtgatcagcggggtgttcccggtctccatccccatcaccgccgcggcctggtacctgtgggaggtgaagaagcagcgcgccggcgtgctctgggacgtccccagcccgccgcccgtggagaaggccgagctggaggacggggcctaccggatcaagcagcgcggcatcctggggtactcccagatcggcgcgggcgtgtacaaggaggggacgttccacaccatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgccgtgcagaccaagcccgggatcttcaagacgaacaccggcaccatcggggcggtcagcctggacttctcccccggcaccagcggctcccccatcgtggaccggaaggggaaggtggtcggcctctacgggaacggcgtggtgacgcgcagcggcgcctacgtctccgccatcgcccagaccgagaagtccatcgaggacaaccccgagatcgaggacgacatcttccggaagaagcgcctgaccatcatggacctgcaccccggggcgggcaagaccaagcggtacctccccgccatcgtgcgcgaggccatcaagcgggggctgcgcacgctgatcctggccccgacccgcgtggtcgccgcggagatggaggaggccctccggggcctgcccatccgctaccagacccccgccatcaagaccgagcacacggggcgggagatcgtggacctgatgtgccacgccaccttcaccatgcgcctcctgagccccgtgcgggtcccgaactacaacctgatcatcatggacgaggcccacttcaccgaccccgcgtccatcgccgcccgcggctacatcagcacgcgggtggagatgggcgaggccgccgggatcttcatgaccgcgacgccgcccggctcccgcgacccgttcccccagagcaacgcccccatcatggacgaggagcgggagatccccgagcgctcctggaacagcgggcacgagtgggtgaccgacttcaagggcaagacggtctggttcgtgccgtccatcaaggccgggaacgacatcgccgcgtgcctccggaagaacggcaagaaggtgatccagctgagccgcaagaccttcgactccgagtacgtcaagacccgggccaacgactgggacttcgtggtgaccacggacatcagcgagatgggcgccaacttcaaggccgagcgcgtcatcgacccccggcgctgcatgaagcccgtgatcctgaccgacggggaggagcgggtgatcctcgccggccccatgccggtcacccactccagcgcggcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgccatcgacggcgagtaccgcctgcgcggggaggcgcgcaagacgttcgtggacctgatgcggcgcggcgacctccccgtctggctggcctacaaggtggccgccgaggggatcaactacgccgaccggaagtggtgcttcgacggcatcaagaacaaccagatcctggaggagaacatggaggtggagatctggaccaaggagggggagcgcaagaagctcaagccgcggtggctggacgcgcgcatctacagcgaccccctggccctcaaggagttcaaggagttcgccgccggccggaagtccctgaccctgaacctcatcaccgagatgggccgcctgcccacgttcatgacccagaaggcgcggaacgccctggacaacctcgccgtcctgcacaccgccgaggccgggggccgcgcgtacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggccagcatcctgctctggtacgcccagatccagccgcactggatcgcggcctccatcatcctggagttcttcctgatcgtcctcctgatccccgagcccgagaagcagcggacgccccaggacaaccagctgacctacgtggtgatcgccatcctcaccgtcgtggccgccacgatggcgaacgagatgggcttcctggagaagaccaagaaggacctggggctcggcagcatcaccacccaggagagcgagtccaacatcctggacatcgacctgcgcccggccagcgcctggacgctctacgccgtggccaccaccttcgtcacccccatgctgcggcactccatcgagaacagctccgtgaacgtgagcctgacggcgatcgccaaccaggccaccgtcctcatgggcctggggaagggctggcccctgtccaagatggacatcggggtgcccctcctggccatcggctgctacagccaggtgaacccgatcaccctgaccgcggccctcctgctgctcgtcgcccactacgccatcatcgggcccggcctgcaggccaaggcgacgcgcgaggcccagaagcgggccgccgccggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcgcacgacctgggcgctgtgcgaggccctcaccctggccaccgggcccatctccacgctgtgggagggcaaccccgggcggttctggaacaccaccatcgccgtcagcatggccaacatcttccgcggctcctacctcgcgggcgccgggctgctgttcagcatcatgaagaacaccacgtccacccgccggggcaccgggaacatcggcgagaccctcggcgagaagtggaagtcccgcctgaacgccctggggaagtccgagttccagatctacaagaagtccggcatccaggaggtggaccggacgctcgccaaggaggggatcaagcgcggcgagaccgaccaccacgcggtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacgtacgggtggaacctggtccgcctccagagcggcgtggacgtgttcttcaccccgcccgagaagtgcgacaccctgctgtgcgacatcggggagtccagccccaaccccaccatcgaggccggccggaccctccgcgtcctgaacctggtggagaactggctcaacaacaacacgcagttctgcatcaaggtgctgaacccgtacatgccctccgtcatcgagaagatggaggccctgcagcggcagtacggcggggccctcgtgcgcaaccccctgagccggaactccacccacgagatgtactgggtgagcaacgcgaccggcaacatcgtctccagcgtgaacatgatctcccgcatgctgatcaaccggttcaccatgaagcacaagaaggccacgtacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagacggggagcgcctccagcatggtcaacggcgtggtgcgcctgctgaccaagccctgggacgtcgtgccgatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagacgccccgcatgtgcacccgggaggagttcacgaagaaggtgcgctccaacgccgccctcggggccatcttcaccgacgagaacaagtggaagtccgcccgggaggcggtcgaggacggccgcttctgggagctggtggaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcccggttcctcgagttcgaggcgctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacgcggatcaccctggaggacctgaagaacgaggagatggtcaccaaccacatgaagggggagcacaagaagctcgccgaggcgatcttcaagctgacctaccagaacaaggtggtgcgcgtccagcggccgacgccccgcggcaccgtgatggacatcatcagccggcgcgaccagcggggctccgggcaggtcggcacctacgggctgaacaccttcacgaacatggaggcccagctcatccgccagatggagggcgagggcatcttcaagagcatccagcacctgaccgccaccgaggagatcgccgtccagaactggctggcccgcgtggggcgggagcgcctctcccggatggcgatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcccgcatcagccagggcgcggggtggtccctcaaggagaccgcctgcctgggcaagagctacgcccagatgtggaccctgatgtacttccaccggcgcgacctccggctggccgccaacgcgatctgctccgccgtgcccagccactgggtgcccacctcccgcaccacgtggagcatccacgccaagcacgagtggatgaccaccgaggacatgctggccgtctggaaccgggtgtggatccaggagaacccgtggatggaggacaagacccccgtggagtcctgggaggaggtcccctacctcgggaagcgcgaggaccagtggtgcggcagcctgatcgggctgacgagccgggcgacctgggccaagaacatccagaccgccatcaaccaggtgcgctccctcatcggcaacgaggagtacaccgactacatgcccagcatgaagcggttccgccgcgaggaggaggaggccggcgtgctgtggtga

SEQ ID NO: 9284 - RNA, 9876 nt, synthetic construct
  misc_feature 1..9876: note = derived and/or modified CDS sequence (opt1) from DENV-2__EU482685__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggaacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtcacccccatgctgcggcactccatcgagaacagctccgtgaacgtgagcctgaccgccatcgccaaccaggccacggtcctcatgggcctggggaagggctggcccctgtccaagatggacatcggggtgcccctcctggcgatcggctgctacagccaggtgaacccgatcaccctgaccgccgccctcctgctgctcgtcgcccactacgccatcatcgggcccggcctgcaggcgaaggccacccgcgaggcccagaagcgggccgccgcgggcatcatgaagaaccccacggtggacgggatcaccgtgatcgacctggagcccatcccgtacgaccccaagttcgagaagcagctcggccaggtcatgctgctgatcctctgcgtgacccaggtgctgatgatgcgcaccacgtgggccctgtgcgaggccctcaccctggccaccgggcccatctccaccctgtgggagggcaaccccgggcggttctggaacacgaccatcgccgtcagcatggcgaacatcttccgcggctcctacctcgccggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtggaccggaccctcgcgaaggaggggatcaagcgcggcgagacggaccaccacgccgtgtcccgggggagcgccaagctgcgctggttcgtcgagcggaacatggtgaccccggagggcaaggtggtcgacctgggctgcgggcgcggcgggtggtcctactactgcggcgggctcaagaacgtgcggcaggtcaagggcctgaccaagggcgggcccggccacgaggagcccatccccatgagcacctacgggtggaacctggtccgcctccagagcggcgtggacgtgttcttcacgccgcccgagaagtgcgacaccctgctgtgcgacatcggggagtccagccccaaccccaccatcgaggccggccggaccctccgcgtcctgaacctggtggagaactggctcaacaacaacacccagttctgcatcaaggtgctgaacccgtacatgccctccgtcatcgagaagatggaggccctgcagcggcagtacggcggggcgctcgtgcgcaaccccctgagccggaactccacgcacgagatgtactgggtgagcaacgccaccggcaacatcgtctccagcgtgaacatgatctcccgcatgctgatcaaccggttcaccatgaagcacaagaaggccacctacgagccggacgtggacctggggagcggcacgcgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagaccgggagcgcctccagcatggtcaacggcgtggtgcgcctgctgacgaagccctgggacgtcgtgccgatggtgacccagatggcgatgaccgacaccacgcccttcgggcagcagcgcgtcttcaaggagaaggtggacacccggacccaggagcccaaggagggcaccaagaagctcatgaagatcacggccgagtggctgtggaaggagctgggcaagaagaagacgccccgcatgtgcacccgggaggagttcaccaagaaggtgcgctccaacgccgccctcggggccatcttcacggacgagaacaagtggaagtccgcgcgggaggccgtcgaggacggccgcttctgggagctggtggaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtcgagggggagggcctgcaccggctgggctacatcctccgcgacgtggggaagaaggagggcggggccatgtacgccgacgacaccgccggctgggacacccggatcacgctggaggacctgaagaacgaggagatggtcaccaaccacatgaagggggagcacaagaagctcgcggaggccatcttcaagctgacctaccagaacaaggtggtgcgcgtccagcggccgacgccccgcggcacggtgatggacatcatcagccggcgcgaccagcggggctccggccaggtgggcacctacgggctgaacaccttcaccaacatggaggcccagctcatccgccagatggagggcgagggcatcttcaagagcatccagcacctgacggccaccgaggagatcgccgtccagaactggctggcgcgcgtggggcgggagcgcctctcccggatggccatcagcggcgacgactgcgtggtcaagcccatcgacgaccgcttcgcctccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcgcgcatcagccagggcgccgggtggtccctcaaggagacggcctgcctgggcaagagctacgcccagatgtggaccctgatgtacttccaccggcgcgacctccggctggccgcgaacgccatctgctccgccgtgcccagccactgggtgcccacctcccgcaccacctggagcatccacgccaagcacgagtggatgacgaccgaggacatgctggcggtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacgtgggccaagaacatccagaccgccatcaaccaggtgcgctccctcatcggcaacgaggagtacaccgactacatgcccagcatgaagcggttccgccgcgaggaggaggaggccggcgtgctgtggtga

SEQ ID NO: 9285 - RNA, 9876 nt, synthetic construct
  misc_feature 1..9876: note = derived and/or modified CDS sequence (opt1) from DENV-2__EU482687__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcggtgctggcctacaccatcgggaccacgcacttccagcgggccctcatcttcgtcctgctgaccgccgtggcgcccagcatgaccatgcgctgcatcggcatcagcaaccgggacttcgtggagggcgtcagcgggggcagctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtcgtggtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtcttcggcgcgatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggccgtggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacgcagaccgcggggccctggcacctcggcaagctggagatggacttcgacttctgcgaggggaccaccgtggtggtcacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacccgcatcggcacgaagcacgcgatcctgctcgtggccgtgagcttcgtcaccctgatcaccgggaacatgtccttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtcctgaagatcgtgcgcaacatggagaagtaccagctcgccgtgacgatcatggccatctcctgcgtcccgaacgccgtgatcctgcagaacgcgtggaaggtcagctgcaccatcctggccgccgtgtccgtgagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtcggcatggtgagcatcctcgcctccagcctgctgaagaacgacatccccatgacggggcccctcgtggcgggcgggctgctgaccgtctgctacgtgctcaccggccggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagacgctgaccatcctgatccggaccggcctcctggtcatcagcggggtgttcccggtgtccatccccatcaccgcggccgcctggtacctgtgggaggtcaagaagcagcgcgccggcgtgctctgggacgtgcccagcccgccgcccgtcgagaaggccgagctggaggacggggcgtaccggatcaagcagcgcggcatcctggggtactcccagatcggcgccggcgtgtacaaggaggggaccttccacacgatgtggcacgtgacccggggcgccgtcctcatgcaccgcgggaagcggatcgagcccagctgggccgacgtgaagaaggacctgatctcctacggcgggggctggaagctggagggcgagtggaaggagggggaggaggtgcaggtcctcgccctggagcccggcaagaacccccgcgcggtgcagaccaagcccgggatcttcaagaccaacacgggcaccatcggggccgtgagcctggacttctcccccggcaccagcggctcccccatcgtcgaccggaaggggaaggtggtgggcctctacgggaacggcgtcgtgacccgcagcggcgcctacgtgtccgccatcgcgcagacggagaagtccatcgaggacaaccccgagatcgaggacgacatcttccggaagaagcgcctgaccatcatggacctgcaccccggggccggcaagaccaagcggtacctccccgccatcgtccgcgaggccatcaagcgggggctgcgcaccctgatcctggccccgacgcgcgtggtggcggccgagatggaggaggccctccggggcctgcccatccgctaccagacccccgccatcaagaccgagcacaccgggcgggagatcgtcgacctgatgtgccacgccacgttcaccatgcgcctcctgagccccgtgcgggtgccgaactacaacctgatcatcatggacgaggcgcacttcaccgaccccgcctccatcgccgcccgcggctacatcagcacccgggtcgagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggccgggaacgacatcgcggcctgcctccggaagaacggcaagaaggtgatccagctgagccgcaagacgttcgactccgagtacgtgaagacccgggccaacgactgggacttcgtcgtgaccaccgacatcagcgagatgggcgccaacttcaaggccgagcgcgtgatcgacccccggcgctgcatgaagcccgtcatcctgacggacggggaggagcgggtgatcctcgcgggccccatgccggtgacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtcgacgcgatcgacggcgagtaccgcctgcgcggggaggcccgcaagaccttcgtggacctgatgcggcgcggcgacctccccgtgtggctggcctacaaggtcgccgccgaggggatcaactacgcggaccggaagtggtgcttcgacggcatcaagaacaaccagatcctggaggagaacatggaggtggagatctggacgaaggagggggagcgcaagaagctcaagccgcggtggctggacgcccgcatctacagcgaccccctggccctcaaggagttcaaggagttcgccgcgggccggaagtccctgaccctgaacctcatcaccgagatgggccgcctgcccaccttcatgacgcagaaggcccggaacgccctggacaacctcgccgtcctgcacaccgccgaggccgggggccgcgcctacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcgcagatccagccgcactggatcgccgcctccatcatcctggagttcttcctgatcgtgctcctgatccccgagcccgagaagcagcggacgccccaggacaaccagctgacctacgtcgtgatcgccatcctcaccgtggtcgccgcgaccatggccaacgagatgggcttcctggagaagacgaagaaggacctggggctcggcagcatcaccacccaggagagcgagtccaacatcctggacatcgacctgcgcccggccagcgcctggaccctctacgccgtggcgacgaccttcgtgacccccatgctgcggcactccatcgagaacagctccgtcaacgtgagcctgaccgccatcgccaaccaggccacggtgctcatgggcctggggaagggctggcccctgtccaagatggacatcggggtccccctcctggcgatcggctgctacagccaggtgaacccgatcaccctgaccgccgccctcctgctgctcgtggcccactacgccatcatcgggcccggcctgcaggcgaaggccacccgcgaggcccagaagcgggccgccgcgggcatcatgaagaaccccacggtcgacgggatcaccgtgatcgacctggagcccatcccgtacgaccccaagttcgagaagcagctcggccaggtgatgctgctgatcctctgcgtcacccaggtgctgatgatgcgcaccacgtgggccctgtgcgaggccctcaccctggccaccgggcccatctccaccctgtgggagggcaaccccgggcggttctggaacacgaccatcgccgtgagcatggcgaacatcttccgcggctcctacctcgccggcgccgggctgctgttcagcatcatgaagaacaccacctccacgcgccggggcaccgggaacatcggcgagaccctcggcgagaagtggaagtcccgcctgaacgccctggggaagtccgagttccagatctacaagaagtccggcatccaggaggtcgaccggaccctcgcgaaggaggggatcaagcgcggcgagacggaccaccacgccgtgtcccgggggagcgccaagctgcgctggttcgtggagcggaacatggtcaccccggagggcaaggtggtggacctgggctgcgggcgcggcgggtggtcctactactgcggcgggctcaagaacgtccgggaggtgaagggcctgaccaagggcgggcccggccacgaggagcccatccccatgagcacctacgggtggaacctggtgcgcctccagagcggcgtcgacgtgttcttcacgccgcccgagaagtgcgacaccctgctgtgcgacatcggggagtccagccccaaccccaccatcgaggccggccggaccctccgcgtgctgaacctggtcgagaactggctcaacaacaacacccagttctgcatcaaggtgctgaacccgtacatgccctccgtgatcgagaagatggaggccctgcagcggcagtacggcggggcgctcgtccgcaaccccctgagccggaactccacgcacgagatgtactgggtgagcaacgccaccggcaacatcgtgtccagcgtcaacatgatctcccgcatgctgatcaaccggttcaccatgaagcacaagaaggccacctacgagccggacgtggacctggggagcggcacgcgcaacatcgggatcgagtccgagatccccaacctcgacatcatcggcaagcggatcgagaagatgaagcaggagcacgagatcagctggcactacgaccaggaccacccctacaagacctgggcctaccacggctcctacgagaccaagcagaccgggagcgcctccagcatggtgaacggcgtcgtgcgcctgctgacgaagccctgggacgtggtcccgatggtgacccagatggcgatgaccgacaccacgcccttcgggcagcagcgcgtgttcaaggagaaggtcgacacccggacccaggagcccaaggagggcaccaagaagctcatgaagatcacggccgagtggctgtggaaggagctgggcaagaagaagacgccccgcatgtgcacccgggaggagttcacccgcaaggtgcggtccaacgccgccctcggggccatcttcacggacgagaacaagtggaagtccgcgcgcgaggccgtggaggacggccggttctgggagctggtcgaccgcgagcggaacctgcacctcgaggggaagtgcgagacctgcgtgtacaacatgatgggcaagcgcgagaagaagctgggggagttcggcaaggccaagggctcccgggccatctggtacatgtggctgggggcgcgcttcctcgagttcgaggccctgggcttcctgaacgaggaccactggttcagccgggggaacagcctctccggcgtcgagggggagggcctgcaccgcctgggctacatcctccgggacgtggggaagaaggagggcggggccatgtacgccgacgacaccgccggctgggacacccgcatcacgctggaggacctgaagaacgaggagatggtgaccaaccacatgaagggggagcacaagaagctcgcggaggccatcttcaagctgacctaccagaacaaggtcgtgcgggtgcagcgcccgacgccccggggcacggtcatggacatcatcagccgccgggaccagcgcggctccggccaggtgggcacctacgggctgaacaccttcaccaacatggaggcccagctcatccgccagatggagggcgagggcatcttcaagagcatccagcacctgacggccaccgaggagatcgccgtgcagaactggctggcgcgggtcgggcgcgagcggctctcccgcatggccatcagcggcgacgactgcgtggtgaagcccatcgacgaccggttcgcctccgccctgaccgccctgaacgacatggggaaggtccgcaaggacatccagcagtgggagcccagccggggctggaacgactggacccaggtgccgttctgctcccaccacttccacgagctcgtgatgaaggacgggcgcgtcctggtggtgccctgccggaaccaggacgagctgatcggccgcgcgcggatcagccagggcgccgggtggtccctcaaggagacggcctgcctgggcaagagctacgcccagatgtggaccctgatgtacttccaccgccgggacctccgcctggccgcgaacgccatctgctccgccgtccccagccactgggtgcccacctcccggaccacctggagcatccacgccaagcacgagtggatgacgaccgaggacatgctggcggtgtggaaccgcgtctggatccaggagaacccgtggatggaggacaagacccccgtggagtcctgggaggaggtgccctacctcgggaagcgggaggaccagtggtgcggcagcctgatcgggctgaccagccgcgccacgtgggccaagaacatccaggccgccatcaaccaggtccggtccctcatcggcaacgaggagtacaccgactacatgcccagcatgaagcgcttccgccgggaggaggaggaggcgggcgtgctgtggtga

SEQ ID NO: 9286 - RNA, 9876 nt, synthetic construct
  misc_feature 1..9876: note = derived and/or modified CDS sequence (opt1) from DENV-2__EU482688__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcatcgagaaggacagccccgtgaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggaccatgaagatcctgatcggcgtcatcatcacgtggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcaccgacaacgtccacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtgaagctcacgatcatgaccggcgacatccgggggatcatgcaggccggcaagcgcagcctgcggccgcagcccaccgagctgaagtactcctggaagacctggggcaaggcgaagatgctcagcacggagtcccacaaccagaccttcctgatcgacgggcccgagaccgccgagtgcccgaacaccaaccgcgcctggaacagcctggaggtcgaggactacggcttcggggtgttcacgaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacccagacggcggggccctggcacctcggcaagctggagatggacttcgacctgtgcgaggggaccaccgtggtggtcaccgaggactgcggcaaccgcggccccagcctccggacgaccaccgccagcgggaagctgatcaccgagtggtgctgccgctcctgcacgctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcaccaagcacgcgatcctcctggtggccgtgagcctggtcacgctcatcaccgggaacatgtccttccgcgacctgggccgcgtgatggtgatggtcggggccaccatgaccgacgacatcggcatgggcgtgacgtacctggccctcctggccgcgttcaaggtgcggcccaccttcgccgccgggctgctcctgcgcaagctgaccagcaaggagctcatgatggccaccatcggcatcgccctgctgtcccagagcacgatccccgagaccatcctcgagctgaccgacgcgctggccctcgggatgatggtcctgaagatcgtgcggaacatggagaagtaccagctggccgtgaccatcatggccatctcctgcgtcccgaacgccgtgatcctccagaacgcgtggaaggtgagctgcacgatcctggccgccgtctccgtgagccccctgctcctgacctccagccagcagaaggccgactggatccccctggcgctcaccatcaagggcctgaaccccaccgccatcttcctgacgaccctctcccgcaccagcaagaagcggtcctggccgctgaacgaggccatcatggccgtcggcatggtgagcatcctggcctccagcctcctgaagaacgacatccccatgaccgggcccctggtggcgggcgggctcctgacggtctgctacgtgctgaccggccgcagcgccgacctcgagctggagcgggccgccgacgtgaagtgggaggaccaggccgagatctccgggagctcccccatcctgagcatcaccatctccgaggacggcagcatgtccatcaagaacgaggaggaggagcagaccctcacgatcctgatccgcaccggcctgctcgtcatcagcggggtgttcccggtgtccatccccatcaccgcggccgcctggtacctgtgggaggtcaagaagcagcgggccggcgtgctgtgggacgtgcccagcccgccgcccgtcgagaaggccgagctcgaggacggggcgtaccgcatcaagcagcggggcatcctggggtactcccagatcggcgccggcgtgtacaaggaggggaccttccacaccatgtggcacgtgacgcgcggcgccgtcctgatgcaccgggggaagcgcatcgagcccagctgggccgacgtgaagaaggacctcatctcctacggcgggggctggaagctggagggcgagtggaaggagggggaggaggtgcaggtcctggccctcgagcccggcaagaacccccgggcggtgcagaccaagcccgggatcttcaagaccaacaccggcacgatcggggccgtgagcctggacttctcccccggcaccagcggctcccccatcgtcgaccgcaaggggaaggtggtgggcctgtacgggaacggcgtcgtgacccggagcggcgcctacgtgtccgccatcgcgcagaccgagaagtccatcgaggacaaccccgagatcgaggacgacatcttccgcaagaagcggctcacgatcatggacctgcaccccggggccggcaagaccaagcgctacctgcccgccatcgtccgggaggccatcaagcgcgggctgcgcaccctcatcctggccccgacccgggtggtggcggccgagatggaggaggccctgcgcggcctccccatccggtaccagacgaccgccatcaagaccgagcacaccgggcgcgagatcgtcgacctgatgtgccacgccacgttcaccatgcggctgctcagccccgtgcgcgtgcccaactacaacctgatcatcatggacgaggcgcacttcaccgacccggcctccatcgccgcccggggctacatcagcacccgcgtcgagatgggcgaggccgcggggatcttcatgacggccacgccgcccggctcccgggaccccttcccgcagagcaacgcccccatcatggacgaggagcgcgagatccccgagcggtcctggaacagcgggcacgagtgggtgaccgacttcaagggcaagaccgtgtggttcgtcccctccatcaaggccgggaacgacatcgcggcctgcctgcgcaagaacggcaagaaggtgatccagctcagccggaagacgttcgactccgagtacgtgaagacccgcgccaacgactgggacttcgtcgtgaccaccgacatcagcgagatgggcgccaacttcaaggccgagcgggtgatcgacccgcgccggtgcatgaagcccgtcatcctgacggacggggaggagcgcgtgatcctggcgggccccatgcccgtgacccactccagcgccgcccagcggcgcgggcgcatcggccggaacccgaagaacgagaacgaccagtacatctacatgggggagcccctcgagaacgacgaggactgcgcccactggaaggaggccaagatgctgctggacaacatcaacacccccgagggcatcatcccctccatgttcgagccggagcgcgagaaggtcgacgcgatcgacggcgagtaccggctccgcggggaggcccggaagaccttcgtggacctgatgcgccggggcgacctgcccgtgtggctcgcctacaaggtcgccgccgaggggatcaactacgcggaccgcaagtggtgcttcgacggcatcaagaacaaccagatcctggaggagaacatggaggtggagatctggacgaaggagggggagcggaagaagctgaagccccgctggctcgacgcccggatctacagcgacccgctggccctgaaggagttcaaggagttcgccgcgggccgcaagtccctcaccctgaacctgatcaccgagatgggccggctccccaccttcatgacgcagaaggcccgcaacgccctggacaacctggccgtgctccacaccgccgaggccgggggccgggcctacaaccacgccctgagcgagctgcccgagaccctcgagaccctgctgctcctgacgctgctcgccaccgtcaccgggggcatcttcctgttcctgatgtccggcaaggggatcggcaagatgaccctcgggatgtgctgcatcatcaccgccagcatcctgctgtggtacgcgcagatccagccccactggatcgccgcctccatcatcctcgagttcttcctgatcgtgctgctcatcccggagcccgagaagcagcgcacgccccaggacaaccagctgacctacgtcgtgatcgccatcctgaccgtggtcgccgcgaccatggccaacgagatgggcttcctcgagaagacgaagaaggacctggggctgggcagcatcaccacccaggagagcgagtccaacatcctcgacatcgacctgcggcccgccagcgcctggaccctgtacgccgtggcgacgaccttcgtgaccccgatgctccgccactccatcgagaacagctccgtcaacgtgagcctgaccgccatcgccaaccaggccacggtgctgatgggcctcgggaagggctggcccctgtccaagatggacatcggggtccccctgctcgcgatcggctgctacagccaggtgaaccccatcaccctgaccgccgccctgctcctgctggtggcccactacgccatcatcgggccgggcctccaggcgaaggccacccgggaggcccagaagcgcgccgccgcgggcatcatgaagaaccccacggtcgacgggatcaccgtgatcgacctggagcccatcccctacgacccgaagttcgagaagcagctgggccaggtgatgctcctgatcctgtgcgtcacccaggtgctcatgatgcggaccacgtgggccctgtgcgaggccctgaccctcgccaccgggcccatctccaccctgtgggagggcaaccccgggcgcttctggaacacgaccatcgccgtgagcatggcgaacatcttccgcggctcctacctggccggcgccgggctcctgttcagcatcatgaagaacaccaccaacacgcggcgcggcaccgggaacatcggcgagaccctgggcgagaagtggaagtcccggctcaacgccctgggcaagagcgagttccagatctacaagaagtccggcatccaggaggtcgaccgcaccctggcgaaggaggggatcaagcggggcgagacggaccaccacgccgtgagccgcgggtccgccaagctccggtggttcgtggagcgcaacatggtcacccccgagggcaaggtggtggacctgggctgcgggcggggcgggtggagctactactgcggcgggctgaagaacgtccgcgaggtgaagggcctcaccaagggcgggccgggccacgaggagcccatccccatgtccacctacgggtggaacctggtgcggctgcagagcggcatcgacgtcttcttcacgcccccggagaagtgcgacaccctcctgtgcgacatcggggagagctcccccaaccccaccatcgaggccggccgcaccctgcgggtgctcaacctggtggagaactggctgaacaacaacacccagttctgcatcaaggtcctcaacccctacatgccgagcgtgatcgagaagatggaggccctgcagcgcaagtacggcggggcgctggtgcggaaccccctgtcccgcaacagcacgcacgagatgtactgggtctccaacgccaccggcaacatcgtgagctccgtgaacatgatcagccggatgctcatcaaccgcttcaccatgaagcacaagaaggccacctacgagcccgacgtcgacctggggtccggcacgcggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccgcctcctgaccaagccctgggacgtggtgcccatggtcacccagatggcgatgaccgacacgaccccgttcgggcagcagcgggtgttcaaggagaaggtggacacccgcacccaggagcccaaggagggcacgaagaagctgatgaagatcaccgccgagtggctctggaaggagctgggcaagaagaagacgccccggatgtgcacccgcgaggagttcacgcggaaggtccgcagcaacgccgccctgggggccatcttcaccgacgagaacaagtggaagtccgcgcgggaggccgtggaggacggccgcttctgggagctcgtggaccgggagcgcaacctgcacctggaggggaagtgcgagacctgcgtctacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgggaacagcctgagcggcgtggagggggagggcctccaccggctgggctacatcctgcgcgacgtggggaagaaggagggcggggccatgtacgccgacgacaccgccggctgggacacgcggatcaccctcgaggacctgaagaacgaggagatggtcaccaaccacatgaagggggagcacaagaagctggcggaggccatcttcaagctcacctaccagaacaaggtggtccgcgtgcagcggcccacgccgcgcggcaccgtgatggacatcatctcccggcgcgaccagcgcggcagcgggcaggtcggcacctacgggctgaacaccttcacgaacatggaggcccagctgatccggcagatggagggcgagggcatcttcaagtccatccagcacctcaccgccaccgaggagatcgccgtgcagaactggctggcgcgcgtggggcgggagcgcctgagccggatggccatctccggcgacgactgcgtcgtgaagcccatcgacgaccgcttcgccagcgccctcaccgccctgaacgacatggggaaggtgcggaaggacatccagcagtgggagccctcccgcggctggaacgactggacgcaggtccccttctgcagccaccacttccacgagctggtgatgaaggacgggcgggtgctcgtcgtgccgtgccgcaaccaggacgagctgatcggccgggcgcgcatctcccagggcgccgggtggagcctgaaggagaccgcctgcctcggcaagtcctacgcccagatgtggaccctgatgtacttccaccggcgcgacctgcggctcgccgcgaacgccatctgcagcgccgtgccctcccactgggtccccaccagccgcaccacgtggtccatccacgccaagcacgagtggatgaccaccgaggacatgctggcggtgtggaaccgggtgtggatccaggagaacccctggatggaggacaagaccccggtcgagagctgggaggaggtgccctacctggggaagcgcgaggaccagtggtgcggctccatgatcgggctcacgagccgggccacctgggccaagaacatccagaccgccatcaaccaggtgcgcagcctgatcggcaacgaggagtacaccgactacatgccctccatgaagcgcttccggcgcgaggaggaggaggccggcgtcctgtggtga

SEQ ID NO: 9287 - RNA, 9876 nt, synthetic construct
  misc_feature 1..9876: note = derived and/or modified CDS sequence (opt1) from DENV-2__EU482691__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacatcaaccgggcctggaacagcctggaggtggaggactacggcttcggggtgttcacgaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtggtcgtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcaccaagcacgcgatcctgctcgtggccgtcagcttcgtgacgctgatcaccgggaacatgtccttccgggacctgggccgcgtgatggtcatggtgggggccaccatgaccgacgacatcggcatgggcgtgacgtacctcgccctgctggccgcgttcaaggtccgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtgctgaagatcgtgcgcaacatggagaagtaccagctcgccgtcaccatcatggccatctcctgcgtgccgaacgccgtgatcctgcagaacgcgtggaaggtcagctgcacgatcctggccgccgtgtccgtcagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtgggcatggtgagcatcctcgcctccagcctgctgaagaacgacatccccatgaccgggcccctcgtcgcgggcgggctgctgacggtgtgctacgtgctcaccggccggagcgccgacctggagctggagcgcgccgccgacgtccggtgggaggaccaggccgagatctccgggagctcccccatcctcagcatcaccatctccgaggacggcagcatgtccatcaagaacgaggaggaggagcagaccctgacgatcctgatccgcaccggcctcctggtgatcagcggggtgttcccggtctccatccccatcaccgcggccgcctggtacctgtgggaggtgaagaagcagcgggccggcgtgctctgggacgtccccagcccgccgcccgtggagaaggccgagctggaggacggggcgtaccgcatcaagcagcggggcatcctggggtactcccagatcggcgccggcgtgtacaaggaggggaccttccacaccatgtggcacgtcacgcgcggcgccgtgctcatgcaccgggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagaccaagcccgggatcttcaagaccaacaccggcacgatcggggccgtcagcctggacttctcccccggcaccagcggctcccccatcgtggaccgcaaggggaaggtggtcggcctctacgggaacggcgtggtgacccggagcggcgcctacgtctccgccatcgcgcagaccgagaagtccatcgaggacaaccccgagatcgaggacgacatcttccgcaagaagcggctgacgatcatggacctgcaccccggggccggcaagaccaagcgctacctccccgccatcgtgcgggaggccatcaagcgcgggctgcgcaccctgatcctggccccgacccgggtggtcgcggccgagatggaggaggccctccgcggcctgcccatccggtaccagacgcccgccatcaagaccgagcacaccgggcgcgagatcgtggacctgatgtgccacgccaccttcacgatgcggctcctgagccccgtgcgcgtcccgaactacaacctgatcatcatggacgaggcgcacttcaccgaccccgcctccatcgccgcccggggctacatcagcacccgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtgaccgacttcaagggcaagaccgtctggttcgtgccgtccatcaaggccgggaacgacatcgcggcctgcctccgcaagaacggcaagaaggtgatccagctgagccggaagaccttcgactccgagtacgtcaagacgcgcgccaacgactgggacttcgtggtgaccaccgacatcagcgagatgggcgccaacttcaaggccgagcgggtcatcgacccccgccggtgcatgaagcccgtgatcctgaccgacggggaggagcgcgtgatcctcgcgggccccatgccggtcacgcactccagcgccgcccagcggcgcgggcgcatcggccggaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgcgagaaggtggacgcgatcgacggcgagtaccggctgcgcggggaggcccggaagaccttcgtggacctgatgcgccggggcgacctccccgtctggctggcctacaaggtggccgccgaggggatcaactacaccgaccgcaagtggtgcttcgacggcatcaagaacaaccagatcctggaggagaacatggaggtggagatctggacgaaggagggggagcggaagaagctcaagccgcgctggctggacgcgcggatctacagcgaccccctggccctcaaggagttcaaggagttcgccgccggccgcaagtccctgaccctgaacctcatcaccgagatgggccggctgcccaccttcatgacgcagaaggcgcgcaacgccctggacaacctcgccgtcctgcacaccgccgaggccgggggccgggcgtacaaccacgccctgagcgagctccccgagaccctggagaccctgctcctgctgacgctcctggccaccgtgaccgggggcatcttcctgttcctcatgtccggcaaggggatcggcaagatgaccctggggatgtgctgcatcatcaccgccagcatcctgctctggtacgcccagatccagccgcactggatcgcggcctccatcatcctggagttcttcctgatcgtcctcctgatccccgagcccgagaagcagcgcacgccccaggacaaccagctgacctacgtggtgatcgccatcctcaccgtcgtggccgccaccatggcgaacgagatgggcttcctggagaagacgaagaaggacctggggctcggcagcatcaccacccaggagagcgagtccaacatcctggacatcgacctgcggccggccagcgcctggaccctctacgccgtggccacgaccttcgtcacccccatgctgcgccactccatcgagaacagctccgtgaacgtgagcctgaccgcgatcgccaaccaggccacggtcctcatgggcctggggaagggctggcccctgtccaagatggacatcggggtgcccctcctggccatcggctgctacagccaggtgaacccgatcaccctgaccgcggccctcctgctgctcgtcgcccactacgccatcatcgggcccggcctgcaggccaaggcgacccgggaggcccagaagcgcgccgccgccggcatcatgaagaaccccacggtggacgggatcaccgtgatcgacctggagcccatcccgtacgaccccaagttcgagaagcagctcggccaggtcatgctgctgatcctctgcgtgacccaggtgctgatgatgcggaccacgtgggcgctgtgcgaggccctcaccctggccaccgggcccatctccaccctgtgggagggcaaccccgggcgcttctggaacacgaccatcgccgtcagcatggccaacatcttccgcggctcctacctcgcgggcgccgggctgctgttcagcatcatgaagaacaccacctccacgcggcgcggcaccgggaacatcggcgagaccctcggcgagaagtggaagtcccggctgaacgccctggggaagtccgagttccagatctacaagaagtccggcatccaggaggtggaccgcaccctcgccaaggaggggatcaagcggggcgagacggaccaccacgcggtgtcccgcgggagcgccaagctgcggtggttcgtcgagcgcaacatggtgaccccggagggcaaggtggtcgacctgggctgcgggcggggcgggtggtcctactactgcggcgggctcaagaacgtgcgcgaggtgaagggcctgaccaagggcgggcccggccacgaggagcccatccccatgagcacctacgggtggaacctggtccggctccagagcggcgtggacgtgttcttcacgccgcccgagaagtgcgacaccctgctgtgcgacatcggggagtccagccccaaccccaccatcgaggccggccgcaccctccgggtcctgaacctggtggagaactggctcaacaacaacacccagttctgcgtgaaggtcctgaacccgtacatgccctccgtgatcgagaagatggaggccctgcagcgccagtacggcggggccctcgtgcggaaccccctgagccgcaactccacgcacgagatgtactgggtcagcaacgcgaccggcaacatcgtgtccagcgtgaacatgatctcccggatgctgatcaaccgcttcaccatgaagcacaagaaggccacctacgagccggacgtcgacctggggagcggcacgcggaacatcgggatcgagtccgagatccccaacctcgacatcatcggcaagcgcatcgagaagatcaagcaggagcacgagatcagctggcactacgaccaggaccacccctacaagacctgggcctaccacggctcctacgagaccaagcagaccgggagcgcctccagcatggtgaacggcgtggtccgcctgctgacgaagccctgggacgtggtgccgatggtcacccagatggccatgaccgacaccacgcccttcgggcagcagcgggtgttcaaggagaaggtggacacccgcacccaggagcccaaggagggcaccaagaagctcatgaagatcacggcggagtggctgtggaaggagctgggcaagaagaagacgccccggatgtgcacccgcgaggagttcacccggaaggtccgctccaacgccgccctcggggccatcttcacggacgagaacaagtggaagtccgcccgggaggcggtggaggacggccgcttctgggagctggtggaccgggagcgcaacctgcacctcgaggggaagtgcgagacctgcgtctacaacatgatgggcaagcgggagaagaagctgggggagttcggcaaggccaagggctcccgcgccatctggtacatgtggctgggggcccggttcctcgagttcgaggcgctgggcttcctgaacgaggaccactggttcagccgcgggaacagcctctccggcgtggagggggagggcctgcaccggctgggctacatcctccgcgacgtcgggaagaaggagggcggggccatgtacgccgacgacaccgccggctgggacacccggatcacgctggaggacctgaagaacgaggagatggtgaccaaccacatgaagggggagcacaagaagctcgccgaggcgatcttcaagctgacctaccagaacaaggtggtccgcgtgcagcggccgacgccccgcggcacggtgatggacatcatcagccggcgcgaccagcgcggctccgggcaggtcggcacctacgggctgaacaccttcaccaacatggaggcccagctcatccggcagatggagggcgagggcatcttcaagagcatccagcacctgacggccaccgaggagatcgccgtgcagaactggctggcccgcgtggggcgggagcgcctctcccggatggcgatcagcggcgacgactgcgtcgtgaagcccatcgacgaccgcttcgcctccgccctgaccgccctgaacgacatggggaaggtgcggaaggacatccagcagtgggagcccagccgcggctggaacgactggacccaggtcccgttctgctcccaccacttccacgagctcgtgatgaaggacgggcgggtgctggtcgtgccctgccgcaaccaggacgagctgatcggccgggcccgcatcagccagggcgcggggtggtccctcaaggagacggcctgcctgggcaagagctacgcccagatgtggaccctgatgtacttccaccggcgcgacctccggctggccgccaacgcgatctgctccgccgtgcccagccactgggtccccacctcccgcaccacctggagcatccacgccaagcacgagtggatgacgaccgaggacatgctggccgtgtggaaccgggtgtggatccaggagaacccgtggatggaggacaagacccccgtcgagtcctgggaggaggtgccctacctcgggaagcgcgaggaccagtggtgcggcagcctgatcgggctgaccagccgggcgacgtgggccaagaacatccagaccgccatcaaccaggtgcgctccctcatcggcaacgaggagtacaccgactacatgcccagcatgaagcgcttccggcgcgaggaggaggaggccggcgtcctgtggtga

SEQ ID NO: 9288 - RNA, 9876 nt, synthetic construct
  misc_feature 1..9876: note = derived and/or modified CDS sequence (opt1) from DENV-2__EU482693__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatcgagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacctgtgcgaggggaccaccgtggtcgtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacccgcatcggcacgaagcacgcgaccctcctggtggccgtcagcttcgtgaccctgatcaccgggaacatgtccttccgggacctcggccgcgtgatggtcatggtgggggccacgatgaccgacgacatcggcatgggcgtgacctacctggccctgctcgccgcgttcaaggtccgccccaccttcgccgccgggctgctgctccggaagctgacgagcaaggagctgatgatggccaccatcggcatcgccctcctgtcccagagcaccatccccgagaccatcctggagctcacggacgcgctggccctggggatgatggtgctcaagatcgtgcgcaacatggagaagtaccagctggccgtcaccatcatggccatctcctgcgtgccgaacgccgtgatcctgcagaacgcgtggaaggtcagctgcaccatcctcgccgccgtgtccgtcagccccctgctgctcacctccagccagcagaaggccgactggatccccctggcgctgacgatcaagggcctcaaccccaccgccatcttcctgaccaccctgtcccggacgagcaagaagcgctcctggccgctcaacgaggccatcatggccgtgggcatggtgagcatcctggcctccagcctgctcaagaacgacatccccatgaccgggcccctggtcgcgggcgggctgctcaccgtgtgctacgtgctgaccggccggagcgccgacctggagctcgagcgcgccgccgacgtcaagtgggaggaccaggccgagatctccgggagctcccccatcctgagcatcacgatctccgaggacggcagcatgtccatcaagaacgaggaggaggagcagaccctgaccatcctcatccggaccggcctgctggtgatcagcggggtgttcccggtctccatccccatcaccgcggccgcctggtacctctgggaggtgaagaagcagcgcgccggcgtgctgtgggacgtccccagcccgccgcccgtggagaaggccgagctggaggacggggcgtaccggatcaagcagcgcggcatcctcgggtactcccagatcggcgccggcgtgtacaaggaggggacgttccacaccatgtggcacgtcacccggggcgccgtgctgatgcaccgcgggaagcggatcgagcccagctgggccgacgtgaagaaggacctgatctcctacggcgggggctggaagctcgagggcgagtggaaggagggggaggaggtccaggtgctggccctggagcccggcaagaacccccgcgcggtgcagaccaagcccgggatcttcaagacgaacaccggcaccatcggggccgtcagcctcgacttctcccccggcaccagcggctcccccatcgtggaccggaaggggaaggtggtcggcctgtacgggaacggcgtggtgacgcgcagcggcgcctacgtctccgccatcgcgcagaccgagaagtccatcgaggacaaccccgagatcgaggacgacatcttccggaagaagcgcctgaccatcatggacctccaccccggggccggcaagaccaagcggtacctgcccgccatcgtgcgcgaggccatcaagcgggggctgcgcacgctgatcctcgccccgacccgcgtggtcgcggccgagatggaggaggccctgcggggcctgcccatccgctaccagacccccgccatcaagaccgagcacacggggcgggagatcgtggacctcatgtgccacgccaccttcaccatgcgcctgctgagccccgtgcgggtcccgaactacaacctcatcatcatggacgaggcgcacttcaccgaccccgcctccatcgccgcccgcggctacatcagcacgcgggtggagatgggcgaggccgcggggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagacggtctggttcgtgccgtccatcaaggccgggaacgacatcgcggcctgcctgcggaagaacggcaagaaggtgatccagctgagccgcaagaccttcgactccgagtacgtcaagacccgggccaacgactgggacttcgtggtgaccacggacatcagcgagatgggcgccaacttcaaggccgagcgcgtcatcgacccccggcgctgcatgaagcccgtgatcctcaccgacggggaggagcgggtgatcctggcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgggagaaggtggacgcgatcgacggcgagtaccgcctgcgcggggaggcccgcaagacgttcgtggacctcatgcggcgcggcgacctgcccgtctggctggcctacaaggtggccgccgaggggatcaactacgcggaccggaagtggtgcttcgacggcatcaagaacaaccagatcctcgaggagaacatggaggtggagatctggaccaaggagggggagcgcaagaagctgaagccgcggtggctggacgcccgcatctacagcgaccccctcgccctgaaggagttcaaggagttcgccgcgggccggaagtccctgaccctcaacctgatcaccgagatgggccgcctgcccacgttcatgacccagaaggcccggaacgccctcgacaacctggccgtcctgcacaccgccgaggccgggggccgcgcctacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtgatcgccatcctgaccgtcgtggccgcgacgatggccaacgagatgggcttcctggagaagaccaagaaggacctcgggctgggcagcatcaccacccaggagagcgagtccaacatcctggacatcgacctccgcccggccagcgcctggacgctgtacgccgtggcgaccaccttcgtcacccccatgctgcggcactccatcgagaacagctccgtgaacgtgagcctcacggccatcgccaaccaggccaccgtcctgatgggcctggggaagggctggcccctctccaagatggacatcggggtgcccctgctggcgatcggctgctacagccaggtgaacccgatcaccctcaccgccgccctgctgctcctggtcgcccactacgccatcatcgggcccggcctgcaggcgaaggccacgcgcgaggcccagaagcgggccgccgcgggcatcatgaagaaccccaccgtggacgggatcaccgtgatcgacctcgagcccatcccgtacgaccccaagttcgagaagcagctgggccaggtcatgctgctcatcctgtgcgtgacccaggtgctgatgatgcgcacgacctgggccctctgcgaggccctgaccctggccaccgggcccatctccacgctctgggagggcaaccccgggcggttctggaacaccaccatcgccgtcagcatggcgaacatcttccgcggctcctacctggccggcgccgggctcctgttcagcatcatgaagaacaccacgtccacccgccggggcaccgggaacatcggcgagaccctgggcgagaagtggaagtcccgcctgaacgccctcgggaagtccgagttccagatctacaagaagtccggcatccaggaggtggaccggacgctggcgaaggaggggatcaagcgcggcgagaccgaccaccacgccgtgtcccgggggagcgccaagctgcgctggttcgtcgagcggaacatggtgaccccggagggcaaggtggtcgacctcggctgcgggcgcggcgggtggtcctactactgcggcgggctgaagaacgtgcgggaggtgaagggcctgaccaagggcgggcccggccacgaggagcccatccccatgagcacgtacgggtggaacctcgtccgcctgcagagcggcgtggacgtgttcttcaccccgcccgagaagtgcgacaccctgctctgcgacatcggggagtccagccccaaccccaccatcgaggccggccggaccctgcgcgtcctgaacctcgtggagaactggctgaacaacaacacgcagttctgcatcaaggtgctgaacccgtacatgccctccgtcatcgagaagatggaggccctccagcggaagtacggcggggcgctggtgcgcaaccccctgagccggaactccacccacgagatgtactgggtgagcaacgccaccggcaacatcgtctccagcgtgaacatgatctcccgcatgctgatcaaccggttcaccatgaagcacaagaaggccacgtacgagccggacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtcaacggcgtggtgcgcctgctcaccaagccctgggacgtcgtgccgatggtgacccagatggcgatgacggacaccacccccttcgggcagcagcgcgtcttcaaggagaaggtggacacccggacgcaggagcccaaggagggcaccaagaagctgatgaagatcaccgccgagtggctgtggaaggagctcggcaagaagaagacgccccgcatgtgcacgcgggaggagttcacccgcaaggtgcggtccaacgccgccctgggggccatcttcaccgacgagaacaagtggaagtccgcgcgcgaggccgtcgaggacggccggttctgggagctggtggaccgcgagcggaacctccacctggaggggaagtgcgagacctgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtcgagggggagggcctgcaccgcctcggctacatcctgcgggacgtgagcaagaaggagggcggcgccatgtacgccgacgacacggccgggtgggacacccgcatcaccctggaggacctcaagaacgaggagatggtcaccaaccacatgaagggcgagcacaagaagctggcggaggccatcttcaagctgacgtaccagaacaaggtggtgcgggtccagcgcccgacgccccgggggaccgtgatggacatcatctcccgccgggaccagcgcggcagcggccaggtggggacctacggcctcaacacgttcaccaacatggaggcccagctgatccgccagatggagggggagggcatcttcaagtccatccagcacctgaccgccgccgaggagaacgtcgtgcagaactggctcgcgcgggtgggccgcgagcggctgagccgcatggccatctccggggacgactgcgtcgtgaagcccatcgacgaccggttcgccagcgccctgaccgccctcaacgacatgggcaaggtgcgcaaggacatccagcagtgggagccctcccgggggtggaacgactggacgcaggtcccgttctgcagccaccacttccacgagctggtgatgaaggacggccgcgtgctggtcgtgccctgccggaaccaggacgagctcatcgggcgcgcgcggatctcccagggcgccggctggagcctgaaggagaccgcctgcctggggaagtcctacgcccagatgtggaccctcatgtacttccaccgccgggacctgcgcctggccgcgaacgccatctgcagcgccgtgccctcccactgggtccccaccagccggaccacgtggtccatccacgccaagcacgagtggatgaccaccgaggacatgctcgcggtgtggaaccgcgtgtggatccaggagaacccgtggatggaggacaagacccccgtcgagagctgggaggaggtgccctacctgggcaagcgggaggaccagtggtgcgggagcctgatcggcctcacgtcccgcgccacctgggccaagaacatccagaccgccatcaaccaggtgcggagcctgatcgggaacgaggagtacaccgactacatgccctccatgaagcgcttccgccgggaggaggaggaggccggcgtcctgtggtga

SEQ ID NO: 9289 - RNA, 9876 nt, synthetic construct
  misc_feature 1..9876: note = derived and/or modified CDS sequence (opt1) from DENV-2__EU596483__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccgtcgtgcaggcggactccggctgcgtggtcagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtcaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtgttcaccaccaacatctggctcaagctgcgcgagaagcaggacgtcttctgcgactccaagctgatgagcgccgccatcaaggacaaccgggcggtgcacgccgacatgggctactggatggagtccgccctcaacgacacctggaagatggagaaggccagcttcatcgaggtgaagtcctgccactggcccaagagccacaccctgtggtccaacggcgtcctggagagcgagatgatcatccccaagaacttcgccgggcccgtgtcccagcacaactaccgcccgggctaccacacgcagaccgcggggccctggcacctcggcaagctggagatggacttcgacttctgcgaggggaccaccgtggtcgtgacggaggactgcggcaaccggggccccagcctgcgcaccaccaccgccagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgcgatcctgctcgtggccgtcagcttcgtgaccctgatcaccgggaacatgtccttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcaccagcaaggagctgatgatggccacgatcggcatcgccctgctctcccagagcaccatccccgagaccatcctggagctgaccgacgcgctcgccctggggatgatggtgctgaagatcgtgcgcaacatggagaagtaccagctcgccgtcacgatcatggccatctcctgcgtgccgaacgccgtgatcctgcagaacgcgtggaaggtcagctgcaccatcctggccgccgtgtccgtcagccccctcctgctgacctccagccagcagaaggccgactggatccccctcgcgctgaccatcaagggcctgaaccccacggccatcttcctcaccaccctgtcccggaccagcaagaagcgctcctggccgctgaacgaggccatcatggccgtgggcatggtgagcatcctcgcctccagcctgctgaagaacgacatccccatgacggggcccctcgtcgcgggcgggctgctgaccgtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagacgctgaccatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtactcccagatcggcgccggcgtgtacaaggaggggaccttccacacgatgtggcacgtcacccggggcgccgtgctcatgcaccgcgggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtcagcctggacttctcccccggcaccagcggctcccccatcgtggaccggaaggggaaggtggtcggcctctacgggaacggcgtggtgacccgcagcggcgcctacgtctccgccatcgcgcagacggagaagtccatcgaggacaaccccgagatcgaggacgacatcttccggaagaagcgcctgaccatcatggacctgcaccccggggccggcaagaccaagcggtacctccccgccatcgtgcgcgaggccatcaagcgggggctgcgcaccctgatcctggccccgacgcgcgtggtcgcggccgagatggaggaggccctccggggcctgcccatccgctaccagacccccgccatcaagaccgagcacaccgggcgggagatcgtggacctgatgtgccacgccacgttcaccatgcgcctcctgagccccgtgcgggtcccgaactacaacctgatcatcatggacgaggcgcacttcaccgaccccgcctccatcgccgcccgcggctacatcagcacccgggtggagatgggcgaggccgcggggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtctggttcgtgccgtccatcaaggccgggaacgacatcgcggcctgcctccggaagaacggcaagaaggtgatccagctgagccgcaagacgttcgactccgagtacgtcaagacccgggccaacgactgggacttcgtggtgaccaccgacatcagcgagatgggcgccaacttcaaggccgagcgcgtcatcgacccccggcgctgcatgaagcccgtgatcctgacggacggggaggagcgggtgatcctcgcgggccccatgccggtcacccactccagcgccgcccagcgccgggggcgcatcggccgcaaccccaagaacgagaacgaccagtacatctacatgggggagcccctggagaacgacgaggactgcgcccactggaaggaggccaagatgctgctcgacaacatcaacacccccgagggcatcatcccgtccatgttcgagcccgagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacacggaccggaagtggtgcttcgacggcatcaagaacaaccagatcctggaggagaacatggaggtggagatctggaccaaggagggggagcgcaagaagctcaagccgcggtggctggacgcgcgcatctacagcgaccccctggccctcaaggagttcaaggagttcgccgccggccggaagtccctgaccctgaacctcatcaccgagatgggccgcctgcccacgttcatgacccagaaggcgcggaacgccctggacaacctcgccgtcctgcacaccgccgaggccgggggccgcgcgtacaaccacgccctgagcgagctccccgagaccctggagacgctgctcctgctgaccctcctggccaccgtgaccgggggcatcttcctgttcctcatgtccggcaaggggatcggcaagatgaccctggggatgtgctgcatcatcacggccagcatcctgctctggtacgcccagatccagccgcactggatcgcggcctccatcatcctggagttcttcctgatcgtcctcctgatccccgagcccgagaagcagcggacgccccaggacaaccagctgacctacgtggtgatcgccatcctcaccgtcgtggccgccacgatggcgaacgagatgggcttcctggagaagaccaagaaggacctggggctcggcagcatcaccacccaggagagcgagtccaacatcctggacatcgacctgcgcccggccagcgcctggacgctctacgccgtggccaccaccttcgtcacccccatgctgcggcactccatcgagaacagctccgtgaacgtgagcctgacggcgatcgccaaccaggccaccgtcctcatgggcctggggaagggctggcccctgtccaagatggacatcggggtgcccctcctggccatcggctgctacagccaggtgaacccgatcaccctgaccgcggccctcctgctgctcgtcgcccactacgccatcatcgggcccggcctgcaggccaaggcgacgcgcgaggcccagaagcgggccgccgccggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcgcacgacctgggcgctgtgcgaggccctcaccctggccaccgggcccatctccacgctgtgggagggcaaccccgggcggttctggaacaccaccatcgccgtcagcatggccaacatcttccgcggctcctacctcgcgggcgccgggctgctgttcagcatcatgaagaacaccacgtccacccgccggggcaccgggaacatcggcgagaccctcggcgagaagtggaagtcccgcctgaacgccctggggaagtccgagttccagatctacaagaagtccggcatccaggaggtggaccggacgctcgccaaggaggggatcaagcgcggcgagaccgaccaccacgcggtgtcccgggggagcgccaagctgcgctggttcgtcgagcggaacatggtgaccccggagggcaaggtggtcgacctgggctgcgggcgcggcgggtggtcctactactgcggcgggctcaagaacgtgcgggaggtgaagggcctgaccaagggcgggcccggccacgaggagcccatccccatgagcacgtacgggtggaacctggtccgcctccagagcggcgtggacgtgttcttcaccccgcccgagaagtgcgacaccctgctgtgcgacatcggggagtccagccccaaccccaccatcgaggccggccggaccctccgcgtcctgaacctggtggagaactggctcaacaacaacacgcagttctgcatcaaggtgctgaacccgtacatgccctccgtcatcgagaagatggaggccctgcagcggcagtacggcggggccctcgtgcgcaaccccctgagccggaactccacccacgagatgtactgggtgagcaacgcgaccggcaacatcgtctccagcgtgaacatgatctcccgcatgctgatcaaccggttcaccatgaagcacaagaaggccacgtacgagccggacgtggacctggggagcggcacccgcaacatcgggatcgagtccgagatccccaacctcgacatcatcggcaagcggatcgagaagatcaagcaggagcacgagatcagctggcactacgaccaggaccacccctacaagacctgggcctaccacggctcctacgagaccaagcagacggggagcgcctccagcatggtcaacggcgtggtgcgcctgctgaccaagccctgggacgtcgtgccgatggtgacccagatggccatgaccgacacgacccccttcgggcagcagcgcgtcttcaaggagaaggtggacacccggacccaggagcccaaggagggcacgaagaagctcatgaagatcaccgcggagtggctgtggaaggagctgggcaagaagaagacgccccgcatgtgcacccgggaggagttcacgcgcaaggtgcggtccaacgccgccctcggggccatcttcaccgacgagaacaagtggaagtccgcccgcgaggcggtcgaggacggccggttctgggagctggtggaccgcgagcggaacctgcacctcgaggggaagtgcgagacctgcgtgtacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggggaacagcctctccggcgtcgagggggagggcctgcaccgcctgggctacatcctccgggacgtggggaagaaggagggcggggccatgtacgccgacgacaccgccggctgggacacgcgcatcaccctggaggacctgaagaacgaggagatggtcaccaaccacatgaagggggagcacaagaagctcgccgaggcgatcttcaagctgacctaccagaacaaggtggtgcgggtccagcgcccgacgccccggggcaccgtgatggacatcatcagccgccgggaccagcgcggctccgggcaggtcggcacctacgggctgaacaccttcacgaacatggaggcccagctcatccgccagatggagggcgagggcatcttcaagagcatccagcacctgaccgccaccgaggagatcgccgtccagaactggctggcccgggtggggcgcgagcggctctcccgcatggcgatcagcggcgacgactgcgtggtcaagcccatcgacgaccggttcgcctccgccctgaccgccctgaacgacatggggaaggtgcgcaaggacatccagcagtgggagcccagccggggctggaacgactggacccaggtgccgttctgctcccaccacttccacgagctcgtcatgaaggacgggcgcgtgctggtggtcccctgccggaaccaggacgagctgatcggccgcgcccggatcagccagggcgcggggtggtccctcaaggagaccgcctgcctgggcaagagctacgcccagatgtggaccctgatgtacttccaccgccgggacctccgcctggccgccaacgcgatctgctccgccgtgcccagccactgggtgcccacctcccggaccacgtggagcatccacgccaagcacgagtggatgaccaccgaggacatgctggccgtctggaaccgcgtgtggatccaggagaacccgtggatggaggacaagacccccgtggagtcctgggaggaggtcccctacctcgggaagcgggaggaccagtggtgcggcagcctgatcgggctgacgagccgcgcgacctgggccaagaacatccagaccgccatcaaccaggtgcggtccctcatcggcaacgaggagtacaccgactacatgcccagcatgaagcgcttccgccgggaggaggaggagacgggcgtgctgtggtga

SEQ ID NO: 9290 - RNA, 9876 nt, synthetic construct
  misc_feature 1..9876: note = derived and/or modified CDS sequence (opt1) from DENV-2__EU482597__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgtccgaggagcaggacaagcgcttcatctgcaagcacagcatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccactccggggaggagcacgccgtgggcaacgacaccgggaagcacggcaaggagatcaagatcaccccgcagagctccatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggctccaactggatccagaaggagacgctggtgaccttcaagaacccccacgcgaagaagcaggacgtcgtggtcctcgggagccaggagggcgccatgcacaccgccctgaccggggccacggagatccagatgagctccggcaacctcctgttcaccggccacctgaagtgccgcctgcggatggacaagctccagctgaaggggatgagctactccatgtgcaccggcaagttcaagatcgtgaaggagatcgccgagacccagcacgggacgatcgtgatccgcgtccagtacgagggcgacggcagcccctgcaagatccccttcgagatcaccgacctggagaagcggcacgtgctcgggcgcctgatcaccgtgaacccgatcgtcaccgagaaggactcccccgtgaacatcgaggcggagccgcccttcggcgacagctacatcatcatcggggtggagccgggccagctgaagctcaactggttcaagaaggggtccagcatcggccagatgttcgagacgaccatgcgcggcgccaagcggatggccatcctgggggacaccgcctgggacttcggctccctcgggggcgtcttcaccagcatcgggaaggccctccaccaggtgttcggcgcgatctacggcgccgccttctccggggtgagctggacgatgaagatcctgatcggcgtcatcatcacctggatcgggatgaactcccgcagcacctccctgagcgtgtccctggtgctcgtcggcgtggtgaccctgtacctgggggccatggtccaggcggacagcggctgcgtggtgtcctggaagaacaaggagctcaagtgcggcagcgggatcttcatcacggacaacgtccacacctggaccgagcagtacaagttccagcccgagagcccctccaagctggccagcgccatccagaaggcccacgaggagggcatctgcgggatccggtccgtgacccgcctggagaacctcatgtggaagcagatcacgcccgagctgaaccacatcctgagcgagaacgaggtgaagctcaccatcatgaccggcgacatccgggggatcatgcaggccggcaagcgctccctgcggccgcagcccaccgagctgaagtacagctggaagacgtggggcaaggcgaagatgctctccaccgagagccacaaccagaccttcctgatcgacgggcccgagaccgccgagtgcccgaacacgaaccgcgcctggaactccctggaggtcgaggactacggcttcggggtgttcaccaccaacatctggctcaagctgcgggagaagcaggacgtgttctgcgacagcaagctgatgtccgccgccatcaaggacaaccgcgcggtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgcctccgggaagctgatcacggagtggtgctgccgcagctgcaccctgcccccgctccggtaccgcggcgaggacgggtgctggtacggcatggagatccggcccctgaaggagaaggaggagaacctggtgaactccctcgtgaccgccgggcacggccagatcgacaacttcagcctgggcgtcctggggatggccctcttcctggaggagatgctgcgcacccggatcggcacgaagcacgcgatcctcctggtggccgtgtccttcgtcaccctgatcaccgggaacatgagcttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgacctccaaggagctgatgatggccacgatcggcatcgccctcctgagccagtccaccatccccgagaccatcctggagctcaccgacgcgctggccctggggatgatggtcctcaagatcgtgcggaacatggagaagtaccagctggccgtgacgatcatggccatcagctgcgtcccgaacgccgtgatcctgcagaacgcgtggaaggtgtcctgcaccatcctcgccgccgtcagcgtgagccccctgctgctcaccagctcccagcagaaggccgactggatccccctggcgctgaccatcaagggcctcaaccccacggccatcttcctgaccaccctgagccgcacctccaagaagcggagctggccgctcaacgaggccatcatggccgtcggcatggtgtccatcctggccagcagcctgctcaagaacgacatccccatgacggggcccctggtggcgggcgggctgctcaccgtctgctacgtgctgaccggccgctccgccgacctggagctcgagcgggccgccgacgtgaagtgggaggaccaggccgagatcagcgggtccagccccatcctgtccatcaccatcagcgaggacggctccatgagcatcaagaacgaggaggaggagcagacgctgaccatcctcatccgcaccggcctgctggtcatctccggggtgttcccggtgagcatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtacagccagatcggcgccggcgtgtacaaggaggggaccttccacacgatgtggcacgtgacccgcggcgccgtcctgatgcaccgggggaagcgcatcgagccctcctgggccgacgtgaagaaggacctgatcagctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgtccctcgacttcagccccggcacctccggcagccccatcgtcgaccgcaaggggaaggtggtgggcctgtacgggaacggcgtcgtgacccggtccggcgcctacgtgagcgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgtcccccgtgcgcgtgcccaactacaacctcatcatcatggacgaggcgcacttcaccgacccggccagcatcgccgcccggggctacatctccacgcgcgtcgagatgggcgaggccgcggggatcttcatgaccgccacgccgcccggcagccgggaccccttcccgcagtccaacgcccccatcatggacgaggagcgcgagatccccgagcggagctggaactccgggcacgagtgggtgaccgacttcaagggcaagacggtgtggttcgtccccagcatcaaggccgggaacgacatcgcggcctgcctgcgcaagaacggcaagaaggtgatccagctgtcccggaagaccttcgacagcgagtacgtgaagacccgcgccaacgactgggacttcgtcgtgaccacggacatctccgagatgggcgccaacttcaaggccgagcgggtgatcgacccgcgccggtgcatgaagcccgtcatcctcaccgacggggaggagcgcgtgatcctggcgggccccatgcccgtgacccacagctccgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatccccagcatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctactccgacccgctcgccctgaaggagttcaaggagttcgccgcgggccgcaagagcctgaccctcaacctgatcaccgagatgggccggctgcccacgttcatgacccagaaggcccgcaacgccctcgacaacctggccgtgctgcacaccgccgaggccgggggccgggcctacaaccacgccctctccgagctgcccgagaccctggagacgctcctgctgctcaccctgctggccaccgtcaccgggggcatcttcctcttcctgatgagcggcaaggggatcggcaagatgaccctggggatgtgctgcatcatcacggcctccatcctcctgtggtacgcgcagatccagccccactggatcgccgccagcatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagtccgagagcaacatcctggacatcgacctccggcccgcctccgcctggacgctgtacgccgtggcgaccaccttcgtgaccccgatgctgcgccacagcatcgagaactccagcgtcaacgtgtccctcacggccatcgccaaccaggccaccgtgctgatgggcctggggaagggctggcccctcagcaagatggacatcggggtccccctgctggcgatcggctgctactcccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatcagcacgctctgggagggcaaccccgggcgcttctggaacaccaccatcgccgtgtccatggcgaacatcttccgcggcagctacctggccggcgccgggctcctgttctccatcatgaagaacaccacgaacacccggcgcggcaccgggaacatcggcgagaccctgggcgagaagtggaagtcccggctgaacgccctcgggaagtccgagttccagatctacaagaagtccggcatccaggaggtcgaccgcacgctggcgaaggaggggatcaagcggggcgagaccgaccaccacgccgtgtcccgcgggagcgccaagctgcggtggttcgtggagcgcaacatggtcacccccgagggcaaggtggtggacctcggctgcgggcggggcgggtggtcctactactgcggcgggctgaagaacgtccgcgaggtgaagggcctgaccaagggcgggccgggccacgaggagcccatccccatgagcacgtacgggtggaacctcgtgcggctgcagagcggcgtcgacgtgttcttcacgccgcccgagaagtgcgacaccctgctctgcgacatcggggagtccagccccaaccccaccatcgaggccggccgcaccctgcgggtgctgaacctcgtcgagaactggctgaacaacaacacgcagttctgcatcaaggtgctgaacccctacatgccctccgtgatcgagaagatggaggccctccagcgcaagtacggcggggcgctggtccggaaccccctgagccgcaactccacccacgagatgtactgggtgagcaacgccaccggcaacatcgtgtccagcgtcaacatgatctcccggatgctgatcaaccgcttcaccatgaagcacaagaaggccacgtacgagcccgacgtggacctcgggagcggcacccggaacatcgggatcgagtccgagatcccgaacctggacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgctccaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggctcccgcgccatctggtacatgtggctcggggcgcggttcctggagttcgaggccctgggcttcctcaacgaggaccactggttcagccgcgggaacagcctgtccggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggcccaccccgcgcggcaccgtcatggacatcatcagccggcgcgaccagcgcggctccgggcaggtcggcacctacgggctcaacacgttcaccaacatggaggcccagctgatccggcagatggagggcgagggcatcttcaagagcatccagcacctgaccgccaccgaggagatcgccgtgcagaactggctcgcgcgcgtcgggcgggagcgcctgtcccggatggccatcagcggcgacgactgcgtggtgaagcccatcgacgaccgcttcgcctccgccctgacggccctcaacgacatggggaagatccggaaggacatccagcagtgggagcccagccgcggctggaacgactggacccaggtccccttctgctcccaccacttccacgagctggtgatgaaggacgggcgggtgctggtcgtgccgtgccgcaaccaggacgagctcatcggccgggcgcgcatcagccagggcgccgggtggtccctgaaggagaccgcctgcctgggcaagagctacgcccagatgtggaccctcatgtacttccaccggcgcgacctgcggctggccgcgaacgccatctgctccgccgtgcccagccactgggtccccacctcccgcacgacctggagcatccacgccaagcacgagtggatgaccaccgaggacatgctcgcggtgtggaaccgggtgtggatccaggagaacccctggatggaggacaagacgccggtcgagtcctgggaggaggtgccctacctggggaagcgcgaggaccagtggtgcggcagcctgatcgggctcaccagccgggccacctgggccaagaacatccagaccgccatcaaccaggtgcgctccctgatcggcaacgaggagtacacggactacatgcccagcatgaagcgcttccggcgcgaggaggaggaggccggcgtcctgtggtga

SEQ ID NO: 9291 - RNA, 9876 nt, synthetic construct
  misc_feature 1..9876: note = derived and/or modified CDS sequence (opt1) from DENV-2__EU482598__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcaccgacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtcttcggcgcgatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccggccgggctaccacacgcagaccgcggggccctggcacctcggcaagctggagatggacttcgacctgtgcgaggggaccaccgtcgtggtgacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtcaacagcctcgtgaccgccgggcacggccagatcgacaacttctccctgggcgtgctggggatggccctcttcctggaggagatgctgcgcacccggatcggcacgaagcacgcgatcctcctggtcgccgtgagcttcgtgaccctgatcaccgggaacatgtccttccgcgacctcggccgcgtcatggtgatggtgggggccaccatgacggacgacatcggcatgggcgtcacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtgctcaagatcgtccggaacatggagaagtaccagctggccgtgacgatcatggccatctcctgcgtgccgaacgccgtcatcctgcagaacgcgtggaaggtgagctgcaccatcctcgccgccgtgtccgtcagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtgggcatggtcagcatcctggcctccagcctgctcaagaacgacatccccatgacggggcccctggtggcgggcgggctgctcaccgtgtgctacgtcctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggagaaggccgagctggaggacggggcgtaccgcatcaagcagcggggcatcctcgggtactcccagatcggcgccggcgtctacaaggaggggaccttccacacgatgtggcacgtgacccgcggcgccgtgctgatgcaccgggggaagcgcatcgagcccagctgggccgacgtcaagaaggacctgatctcctacggcgggggctggaagctcgagggcgagtggaaggagggggaggaggtccaggtgctggccctggagcccggcaagaacccccgggcggtccagaccaagcccgggatcttcaagaccaacacgggcaccatcggggccgtgagcctcgacttctcccccggcaccagcggctcccccatcgtggaccgcaaggggaaggtcgtgggcctgtacgggaacggcgtggtcacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtgcgggaggccatcaagcgcgggctgcgcaccctgatcctcgccccgacgcgggtcgtggcggccgagatggaggaggccctgcgcggcctgcccatccggtaccagaccaccgccatcaagaccgagcacacggggcgcgagatcgtggacctcatgtgccacgccaccttcaccatgcggctgctgagccccgtccgcgtgcccaactacaacctcatcatcatggacgaggcgcacttcaccgacccggcctccatcgccgcccggggctacatcagcacgcgcgtggagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtcaccgacttcaagggcaagacggtgtggttcgtgccctccatcaaggccgggaacgacatcgcggcctgcctgcgcaagaacggcaagaaggtcatccagctgagccggaagaccttcgactccgagtacgtgaagacccgcgccaacgactgggacttcgtggtcaccacggacatcagcgagatgggcgccaacttcaaggccgagcgggtgatcgacccgcgccggtgcatgaagcccgtgatcctcaccgacggggaggagcgcgtcatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtggacgcgatcgacggcgagtaccggctgcgcggggaggcccggaagacgttcgtcgacctcatgcgccggggcgacctgcccgtgtggctggcctacaaggtggccgccgaggggatcaactacgcggaccgcaagtggtgcttcgacggcatcaagaacaaccagatcctcgaggagaacatggaggtcgagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtcctgctgatcccggagcccgagaagcagcgcacgccccaggacaaccagctcacctacgtggtcatcgccatcctgaccgtggtggccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtcgcgaccaccttcgtgaccccgatgctgcgccactccatcgagaacagctccgtgaacgtcagcctcacggccatcgccaaccaggccaccgtgctgatgggcctggggaagggctggcccctctccaagatggacatcggggtgcccctgctggcgatcggctgctacagccaggtcaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtggacgggatcaccgtcatcgacctcgagcccatcccctacgacccgaagttcgagaagcagctgggccaggtgatgctgctcatcctgtgcgtgacccaggtcctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtggaccgcacgctggcgaaggaggggatcaagcggggcgagaccgaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgaccaagggcgggccgggccacgaggagcccatccccatgtccacgtacgggtggaacctcgtgcggctgcagagcggcgtggacgtcttcttcacgccgcccgagaagtgcgacaccctgctctgcgacatcggggagagctcccccaaccccaccatcgaggccggccgcaccctgcgggtgctgaacctcgtggagaactggctgaacaacaacacgcagttctgcatcaaggtcctgaacccctacatgcccagcgtgatcgagaagatggaggccctccagcgcaagtacggcggggcgctggtgcggaaccccctgtcccgcaacagcacccacgagatgtactgggtctccaacgccaccggcaacatcgtgagctccgtgaacatgatcagccggatgctgatcaaccgcttcaccatgaagcacaagaaggccacgtacgagcccgacgtcgacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtggtccgcctgctcaccaagccctgggacgtggtgcccatggtcacccagatggcgatgacggacaccaccccgttcgggcagcagcgggtgttcaaggagaaggtggacacccgcacgcaggagcccaaggagggcaccaagaagctgatgaagatcaccgccgagtggctgtggaaggagctcggcaagaagaagacgccccggatgtgcacgcgcgaggagttcacccggaaggtccgcagcaacgccgccctgggggccatcttcaccgacgagaacaagtggaagtccgcgcgggaggccgtggaggacggccgcttctgggagctggtggaccgggagcgcaacctccacctggaggggaagtgcgagacctgcgtctacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtggggaagaaggagggcggggccatgtacgccgacgacacggccggctgggacacccggatcaccctggaggacctcaagaacgaggagatggtcaccaaccacatgaagggggagcacaagaagctggcggaggccatcttcaagctgacgtaccagaacaaggtggtccgcgtgcagcggcccaccccgcgcggcaccgtgatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtgcagaactggctcgcgcgcgtggggcgggagcgcctgagccggatggccatctccggcgacgactgcgtcgtgaagcccatcgacgaccgcttcgccagcgccctgacggccctcaacgacatggggaaggtgcggaaggacatccagcagtgggagccctcccgcggctggaacgactggacccaggtccccttctgcagccaccacttccacgagctggtgatgaaggacgggcgggtgctggtcgtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtgccctcccactgggtccccaccagccgcacgacctggtccatccacgccaagcacgagtggatgaccaccgaggacatgctcgcggtgtggaaccgggtgtggatccaggagaacccctggatggaggacaagacgccggtcgagagctgggaggaggtgccctacctggggaagcgcgaggaccagtggtgcggctccctgatcgggctcaccagccgggccacctgggccaagaacatccagaccgccatcaaccaggtgcgcagcctgatcggcaacgaggagtacacggactacatgccctccatgaagcgcttccggcgcgaggaggaggaggccggcgtcctgtggtga

SEQ ID NO: 9292 - RNA, 9876 nt, synthetic construct
  misc_feature 1..9876: note = derived and/or modified CDS sequence (opt1) from DENV-2__EU482603__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgccgagggcatctgcgggatccggagcgtgacccgcctggagaacctcatgtggaagcagatcacgcccgagctgaaccacatcctgtccgagaacgaggtgaagctcaccatcatgaccggcgacatcaaggggatcatgcaggcgggcaagcggagcctgcgcccgcagcccaccgagctgaagtactcctggaagacgtggggcaaggccaagatgctcagcaccgagtcccacaaccagaccttcctgatcgacgggcccgagaccgccgagtgcccgaacacgaaccgggcctggaacagcctggaggtcgaggactacggcttcggggtgttcaccaccaacatctggctcaagctgcgcgagaagcaggacgtgttctgcgactccaagctgatgagcgccgcgatcaaggacaaccgggccgtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgcggggcccgtctcccagcacaactaccgcccgggctaccacacgcagaccgccgggccctggcacctcggcaagctggagatggacttcgacctgtgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctgttcctggaggagatgctgcggacccgcatcggcacgaagcacgccatcctcctggtggccgtgagcttcgtcaccctgatcaccgggaacatgtccttccgggacctcggccgcgtgatggtgatggtcggggccaccatgacggacgacatcggcatgggcgtgacctacctggccctgctcgcggccttcaaggtgcgccccaccttcgccgccgggctgctgctccggaagctgaccagcaaggagctgatgatggccacgatcggcatcgcgctcctgtcccagagcaccatccccgagaccatcctggagctcaccgacgccctggccctggggatgatggtcctcaagatcgtgcgcgacatggagaagtaccagctggccgtgacgatcatggccatctcctgcgtcccgaacgcggtgatcctgcagaacgcctggaaggtgagctgcaccatcctcgccgccgtctccgtgagccccctgctgctcacctccagccagcagaaggcggactggatccccctggccctgaccatcaagggcctcaaccccacggccatcttcctgaccaccctgtcccggaccagcaagaagcgctcctggccgctcaacgaggccatcatggccgtcggcatggtgagcatcctggcgtccagcctgctcaagaacgacatccccatgacggggcccctggtggccggcgggctgctcaccgtctgctacgtgctgaccggccggagcgccgacctggagctcgagcgcgccgccgacgtgaagtgggaggaccaggcggagatctccgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgccgccgcctggtacctctgggaggtcaagaagcagcgcgccggcgtgctgtgggacgtgcccagcccgccgcccgtcgagaaggcggagctggaggacggggcctaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggcgctggagcccggcaagaacccccgcgccgtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgcgatcgcccagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcaccctgatcctcgcgccgacgcgcgtggtggccgccgagatggaggaggccctgcggggcctgcccatccgctaccagacccccgccatcaagaccgagcacaccgggcgggagatcgtcgacctcatgtgccacgcgacgttcaccatgcgcctgctgagccccgtgcgggtgccgaactacaacctcatcatcatggacgaggcccacttcaccgaccccgcctccatcgccgcccgcggctacatcagcacccgggtcgagatgggcgaggcggccgggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggcggagcgcgtgatcgacccccggcgctgcatgaagcccgtcatcctcacggacggggaggagcgggtgatcctggccggccccatgccggtgacccactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtcgacgccatcgacggcgagtaccgcctgcgcggggaggcccgcaagaccttcgtggacctcatgcggcgcggcgacctgcccgtgtggctggcctacaaggtcgccgcggaggggatcaactacgccgaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgcggccggccggaagtccctgaccctcaacctgatcaccgagatgggccgcctgcccaccttcatgacgcagaaggcccggaacgccctcgacaacctggccgtgctgcacaccgcggaggccgggggccgcgcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgcggccaccatggccaacgagatgggcttcctggagaagacgaagaaggacctcgggctgggcagcatcaccacccaggagagcgagtccaacatcctggacatcgacctccgcccggccagcgcctggaccctgtacgcggtggccacgaccttcgtgacccccatgctgcggcactccatcgagaacagctccgtcaacgtgagcctcaccgccatcgccaaccaggcgacggtgctgatgggcctggggaagggctggcccctctccaagatggacatcggggtccccctgctggccatcggctgctacagccaggtgaacccgatcaccctcaccgccgccctgctgctcctggtggcccactacgcgatcatcgggcccggcctgcaggccaaggccacccgcgaggcccagaagcgggccgcggccggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgcggtgagcatggccaacatcttccgcggctcctacctggccggcgccgggctcctcttcagcatcatgaagaacaccacctccacgcgccggggcaccgggaacatcggcgagaccctgggcgagaagtggaagtcccgcctgaacgcgctcgggaagtccgagttccagatctacaagaagtccggcatccaggaggtcgaccggaccctggccaaggaggggatcaagcgcggcgagacggaccaccacgccgtgtcccgggggagcgccaagctgcgctggttcgtggagcggaacatggtcaccccggagggcaaggtggtggacctcggctgcgggcgcggcgggtggtcctactactgcggcgggctgaagaacgtccgggaggtgaagggcctgaccaagggcgggcccggccacgaggagcccatccccatgagcacctacgggtggaacctcgtgcgcctgcagagcggcgtcgacgtgttcttcacgccgcccgagaagtgcgacaccctgctctgcgacatcggggagtccagccccaaccccaccatcgaggccggccggaccctgcgcgtgctgaacctcgtcgagaactggctgaacaacaacacccagttctgcatcaaggtgctgaacccgtacatgccctccgtgatcgagaagatggaggcgctccagcggaagtacggcggggccctggtccgcaaccccctgagccggaactccacgcacgagatgtactgggtgagcaacgccaccggcaacatcgtgtccagcgtcaacatgatctcccgcatgctgatcaaccggttcaccatgaagcacaagaagaccacgtacgagccggacgtggacctcgggagcggcacccgcaacatcgggatcgagtccgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtgaacggcgtcgtgcgcctgctcaccaagccctgggacgtggtcccgatggtgacccagatggcgatgacggacaccacccccttcgggcagcagcgcgtgttcaaggagaaggtcgacacccggacgcaggagcccaaggagggcaccaagaagctgatgaagatcaccgccgagtggctgtggaaggagctcggcaagaagaagacgccccgcatgtgcacgcgggaggagttcacccgcaaggtgcggtccaacgccgccctgggggccatcttcaccgacgagaacaagtggaagtccgcgcgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtggagggggagggcctgcaccgcctcggctacatcctgcgggacgtcagcaagaaggagggcggcgccatgtacgccgacgacacggccgggtgggacacccgcatcaccctggaggacctcaagaacgaggagatggtgaccaaccacatgaagggcgagcacaagaagctggcggaggccatcttcaagctgacgtaccagaacaaggtcgtgcgggtgcagcgcccgacgccccgggggaccgtcatggacatcatctcccgccgggaccagcgcggcagcggccaggtggggacctacggcctcaacacgttcaccaacatggaggcccagctgatccgccagatggagggggagggcatcttcaagtccatccagcacctgaccgccaccgaggagatcgtggtccagaactggctcgcccgggtgggccgcgagcggctgagccgcatggcgatctccggggacgactgcgtggtcaagcccatcgacgaccggttcgccagcgccctgacggccctcaacgacatgggcaaggtgcgcaaggacatccagcagtgggagccctcccgggggtggaacgactggacccaggtgccgttctgcagccaccacttccacgagctggtcatgaaggacggccgcgtgctggtggtcccctgccggaaccaggacgagctcatcgggcgcgcccggatctcccagggcgcgggctggagcctgaaggagaccgcctgcctggggaagtcctacgcccagatgtggaccctcatgtacttccaccgccgggacctgcgcctggccgccaacgcgatctgcagcgccgtgccctcccactgggtgcccaccagccggacgacctggtccatccacgccaagcacgagtggatgaccaccgaggacatgctcgccgtctggaaccgcgtgtggatccaggagaacccgtggatggaggacaagacgcccgtggagagctgggaggaggtcccctacctgggcaagcgggaggaccagtggtgcgggagcctgatcggcctcacctcccgcgcgacctgggccaagaacatccagaccgccatcaaccaggtgcggagcctgatcgggaacgaggagtacacggactacatgccctccatgaagcgcttccgccgggaggaggaggaggccggcgtgctgtggtga

SEQ ID NO: 9293 - RNA, 9876 nt, synthetic construct
  misc_feature 1..9876: note = derived and/or modified CDS sequence (opt1) from DENV-2__EU482599__SS-prME
  source 1..9876: mol_type = other RNA
accgccggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggtcatctcctgcgtgccgaacgccgtgatcctgcagaacgcctggaaggtcagctgcaccatcctcgcggccgtgtccgtcagccccctgctgctcacctccagccagcagaaggccgactggatccccctggccctgaccatcaagggcctcaaccccacggcgatcttcctgaccaccctgtcccgcaccagcaagaagcggtcctggccgctcaacgaggccatcatggccgtgggcatggtgagcatcctggcctccagcctgctcaagaacgacatccccatgacggggcccctggtcgccggcgggctgctcaccgtgtgctacgtgctgaccggccgcagcgcggacctggagctcgagcgggccgccgacgtcaagtgggaggaccaggccgagatctccgggagctcccccatcctgagcatcaccatctccgaggacggcagcatgtccatcaagaacgaggaggaggagcagacgctgaccatcctcatccgcaccggcctgctggtgatcagcggggtgttcccggtctccatccccatcaccgccgcggcctggtacctctgggaggtgaagaagcagcgggccggcgtgctgtgggacgtccccagcccgccgcccgtggagaaggccgagctggaggacggggcctaccgcatcaagcagcggggcatcctcgggtactcccagatcggcgcgggcgtgtacaaggaggggaccttccacacgatgtggcacgtcacccgcggcgccgtgctgatgcaccgggggaagcgcatcgagcccagctgggccgacgtgaagaaggacctgatctcctacggcgggggctggaagctcgagggcgagtggaaggagggggaggaggtccaggtgctggccctggagcccggcaagaacccccgggccgtgcagaccaagcccgggatcttcaagaccaacacgggcaccatcggggcggtcagcctcgacttctcccccggcaccagcggctcccccatcgtggaccgcaaggggaaggtggtcggcctgtacgggaacggcgtggtgacccggagcggcgcctacgtctccgccatcgcccagacggagaagtccatcgaggacaaccccgagatcgaggacgacatcttccgcaagaagcggctgaccatcatggacctccaccccggggcgggcaagaccaagcgctacctgcccgccatcgtgcgggaggccatcaagcgcgggctgcgcaccctgatcctcgccccgacgcgggtggtcgccgcggagatggaggaggccctgcgcggcctgcccatccggtaccagaccaccgccatcaagaccgagcacacggggcgcgagatcgtggacctcatgtgccacgccaccttcaccatgcggctgctgagccccgtgcgcgtccccaactacaacctcatcatcatggacgaggcccacttcaccgacccggcgtccatcgccgcccggggctacatcagcacgcgcgtggagatgggcgaggccgccgggatcttcatgaccgcgacgccgcccggctcccgggaccccttcccgcagagcaacgcccccatcatggacgaggagcgcgagatccccgagcggtcctggaacagcgggcacgagtgggtgaccgacttcaagggcaagacggtctggttcgtgccctccatcaaggccgggaacgacatcgccgcgtgcctgcgcaagaacggcaagaaggtgatccagctgagccggaagaccttcgactccgagtacgtcaagacccgcgccaacgactgggacttcgtggtgaccacggacatcagcgagatgggcgccaacttcaaggccgagcgggtcatcgacccgcgccggtgcatgaagcccgtgatcctcaccgacggggaggagcgcgtgatcctggccggccccatgcccgtcacccactccagcgcggcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtggacgccatcgacggcgagtaccggctgcgcggggaggcgcggaagacgttcgtggacctcatgcgccggggcgacctgcccgtctggctggcctacaaggtggccgccgaggggatcaactacgccgaccgcaagtggtgcttcgacggcatcaagaacaaccagatcctcgaggagaacatggaggtggagatctggaccaaggagggggagcggaagaagctgaagccccgctggctggacgcgcggatctacagcgacccgctcgccctgaaggagttcaaggagttcgccgccggccgcaagtccctgaccctcaacctgatcaccgagatgggccggctgcccacgttcatgacccagaaggcgcgcaacgccctcgacaacctggccgtcctgcacaccgccgaggccgggggccgggcgtacaaccacgccctcagcgagctgcccgagaccctggagacgctcctgctgctcaccctgctggccaccgtgaccgggggcatcttcctcttcctgatgtccggcaaggggatcggcaagatgaccctggggatgtgctgcatcatcacggccagcatcctcctgtggtacgcccagatccagccccactggatcgcggcctccatcatcctggagttcttcctcatcgtcctgctgatcccggagcccgagaagcagcgcacgccccaggacaaccagctcacctacgtggtgatcgccatcctgaccgtcgtggccgccacgatggcgaacgagatgggcttcctggagaagaccaagaaggacctcgggctgggcagcatcaccacccaggagagcgagtccaacatcctggacatcgacctccggcccgccagcgcctggacgctgtacgccgtggccaccaccttcgtcaccccgatgctgcgccactccatcgagaacagctccgtgaacgtgagcctcacggcgatcgccaaccaggccaccgtcctgatgggcctggggaagggctggcccctctccaagatggacatcggggtgcccctgctggccatcggctgctacagccaggtgaaccccatcaccctcaccgcggccctgctgctcctggtcgcccactacgccatcatcgggccgggcctgcaggccaaggcgacgcgggaggcccagaagcgcgccgccgccggcatcatgaagaaccccaccgtggacgggatcaccgtgatcgacctcgagcccatcccctacgacccgaagttcgagaagcagctgggccaggtcatgctgctcatcctgtgcgtgacccaggtgctgatgatgcggacgacctgggcgctctgcgaggccctgaccctggccaccgggcccatctccacgctctgggagggcaaccccgggcgcttctggaacaccaccatcgccgtcagcatggccaacatcttccgcggctcctacctggcgggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtggaccgcacgctggccaaggaggggatcaagcggggcgagaccgaccaccacgcggtgagccgcgggtccgccaagctgcggtggttcgtcgagcgcaacatggtgacccccgagggcaaggtggtcgacctcggctgcgggcggggcgggtggagctactactgcggcgggctgaagaacgtgcgcgaggtgaagggcctgaccaagggcgggccgggccacgaggagcccatccccatgtccacgtacgggtggaacctcgtccggctgcagagcggcgtggacgtgttcttcacgccgcccgagaagtgcgacaccctgctctgcgacatcggggagagctcccccaaccccaccatcgaggccggccgcaccctgcgggtcctgaacctcgtggagaactggctgaacaacaacacgcagttctgcatcaaggtgctgaacccctacatgcccagcgtcatcgagaagatggaggccctccagcgcaagtacggcggggccctggtgcggaaccccctgtcccgcaacagcacccacgagatgtactgggtgtccaacgcgaccggcaacatcgtcagctccgtgaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtcaacggcgtggtgcgcctgctcaccaagccctgggacgtcgtgcccatggtgacccagatggccatgacggacaccaccccgttcgggcagcagcgggtcttcaaggagaaggtggacacccgcacgcaggagcccaaggagggcaccaagaagctgatgaagatcaccgcggagtggctgtggaaggagctcggcaagaagaagacgccccggatgtgcacgcgcgaggagttcacccggaaggtgcgcagcaacgccgccctgggggccatcttcaccgacgagaacaagtggaagtccgcccgggaggcggtcgaggacggccgcttctgggagctggtggaccgggagcgcaacctccacctggaggggaagtgcgagacctgcgtgtacaacatgatgggcaagcgggagaagaagctgggggagttcggcaaggccaagggcagccgcgccatctggtacatgtggctcggggcccggttcctggagttcgaggcgctgggcttcctcaacgaggaccactggttctcccgcgggaacagcctgagcggcgtcgagggggagggcctgcaccggctcggctacatcctgcgcgacgtggggaagaaggagggcggggccatgtacgccgacgacacggccggctgggacacccggatcaccctggaggacctcaagaacgaggagatggtcaccaaccacatgaagggggagcacaagaagctggccgaggcgatcttcaagctgacgtaccagaacaaggtggtgcgcgtccagcggcccaccccgcgcggcaccgtgatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtccagaactggctcgcccgcgtggggcgggagcgcctgagccggatggcgatctccggcgacgactgcgtggtcaagcccatcgacgaccgcttcgccagcgccctgacggccctcaacgacatggggaaggtgcggaaggacatccagcagtgggagccctcccgcggctggaacgactggacccaggtgcccttctgcagccaccacttccacgagctggtcatgaaggacgggcgggtgctggtggtcccgtgccgcaaccaggacgagctcatcggccgggcccgcatctcccagggcgcggggtggagcctgaaggagaccgcctgcctgggcaagtcctacgcccagatgtggaccctcatgtacttccaccggcgcgacctgcggctggccgccaacgcgatctgcagcgccgtgccctcccactgggtgcccaccagccgcacgacctggtccatccacgccaagcacgagtggatgaccaccgaggacatgctcgccgtctggaaccgggtgtggatccaggagaacccctggatggaggacaagacgccggtggagagctgggaggaggtcccctacctggggaagcgcgaggaccagtggtgcggctccctgatcgggctcaccagccgggcgacctgggccaagaacatccagaccgccatcaaccaggtgcgcagcctgatcggcaacgaggagtacacggactacatgccctccatgaagcgcttccggcgcgaggaggaggaggccggcgtgctgtggtga

SEQ ID NO: 9294 - RNA, 9876 nt, synthetic construct
  misc_feature 1..9876: note = derived and/or modified CDS sequence (opt1) from DENV-2__FJ898436__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccttcgtgaccccgatgctgcgccactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacgtacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacggcggggcgctggtccggaaccccctgtcccgcaacagcacccacgagatgtactgggtgtccaacgccaccggcaacatcgtgagctccgtcaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgcctggctgtggaaggagctcggcaagaagaagacgccccggatgtgcacgcgcgaggagttcacccggaaggtgcgcagcaacgccgccctgggggcgatcttcaccgacgagaacaagtggaagtccgcccgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacacggcgggctgggacacccggatcaccctggaggacctcaagaacgaggagatggtgaccaaccacatgaagggggagcacaagaagctggccgaggccatcttcaagctgacgtaccagaacaaggtcgtgcgcgtgcagcggcccaccccgcgcggcaccgtcatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgcggtgcagaactggctcgcccgcgtcgggcgggagcgcctgagccggatggccatctccggcgacgactgcgtggtgaagcccatcgacgaccgcttcgccagcgccctgacggcgctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcccgcatctcccagggcgccgggtggagcctgaaggagaccgcctgcctgggcaagtcctacgcccagatgtggaccctcatgtacttccaccggcgcgacctgcggctggcggccaacgccatctgcagcgccgtcccctcccactgggtgcccaccagccgcacgacctggtccatccacgcgaagcacgagtggatgaccaccgaggacatgctcgccgtgtggaaccgggtctggatccaggagaacccctggatggaggacaagacgccggtggagagctgggaggaggtgccctacctggggaagcgcgaggaccagtggtgcggctccctgatcgggctcaccagccgggccacctgggccaagaacatccagaccgccatcaaccaggtccgcagcctgatcggcaacgaggagtacacggactacatgccctccatgaagcgcttccggcgcgaggaggaggaggcgggcgtgctgtggtga

SEQ ID NO: 9295 - RNA, 9876 nt, synthetic construct
  misc_feature 1..9876: note = derived and/or modified CDS sequence (opt1) from DENV-2__EU482634__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctggccgagaacgaggtgaagctcaccatcatgaccggcgacatcaaggggatcatgcaggcgggcaagcggtccctgcgcccgcagcccaccgagctgaagtacagctggaagacgtggggcaaggccaagatgctctccaccgagagccacaaccagaccttcctgatcgacgggcccgagaccgccgagtgcccgaacacgaaccgggcctggaactccctggaggtcgaggactacggcttcggggtgttcaccaccaacatctggctcaagctgcgcgagaagcaggacgtgttctgcgacagcaagctgatgtccgccgcgatcaaggacaaccgggccgtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgcggggcccgtgagccagcacaactaccgcccgggctaccacacgcagaccgccgggccctggcacctcggcaagctggagatggacttcgacctgtgcgaggggaccaccgtggtggtcacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctgttcctggaggagatgctgcggacccgcatcggcacgaagcacgccatcctcctggtggccgtgtccttcgtcaccctgatcaccgggaacatgagcttccgggacctcggccgcgtgatggtgatggtcggggccaccatgacggacgacatcggcatgggcgtgacctacctggccctgctcgcggccttcaaggtgcgccccaccttcgccgccgggctgctgctccggaagctgacctccaaggagctgatgatggccacgatcggcatcgcgctcctgagccagtccaccatccccgagaccatcctggagctcaccgacgccctggccctggggatgatggtcctcaagatcgtgcgcaacatggagaagtaccagctggccgtgacgatcatggccatcagctgcgtcccgaacgcggtgatcctgcagaacgcctggaaggtgtcctgcaccatcctcgccgccgtcagcgtgagccccctgctgctcaccagctcccagcagaaggcggactggatccccctggccctgaccatcaagggcctcaaccccacggccatcttcctgaccaccctgagccggaccaacaagaagcgctcctggccgctcaacgaggccatcatggccgtcggcatggtgagcatcctggcgtccagcctgctcaagaacgacatccccatgacggggcccctggtggccggcgggctgctcaccgtctgctacgtgctgaccggccggtccgccgacctggagctcgagcgcgccgccgacgtgaagtgggaggaccaggcggagatcagcgggagctcccccatcctgagcatcaccatctccgaggacggcagcatgtccatcaagaacgaggaggaggagcagacgctgaccatcctcatccggaccggcctgctggtcatcagcggggtgttcccggtgtccatccccatcaccgccgccgcctggtacctctgggaggtcaagaagcagcgcgccggcgtgctgtgggacgtgccctccccgccgcccgtcgagaaggcggagctggaggacggggcctaccggatcaagcagcgcggcatcctcgggtactcccagatcggcgccggcgtgtacaaggaggggaccttccacacgatgtggcacgtgacccggggcgccgtcctgatgcaccgcgggaagcggatcgagcccagctgggccgacgtgaagaaggacctgatctcctacggcgggggctggaagctcgagggcgagtggaaggagggggaggaggtgcaggtcctggcgctggagcccggcaagaacccccgcgccgtgcagaccaagcccgggatcttcaagaccaacacgggcaccatcggggccgtgagcctcgacttctcccccggcaccagcggctcccccatcgtcgaccggaaggggaaggtggtgggcctgtacgggaacggcgtcgtgacccgcagcggcgcctacgtgtccgcgatcgcccagacggagaagtccatcgaggacaaccccgagatcgaggacgacatcttccggaagaagcgcctgaccatcatggacctccaccccggggccggcaagaccaagcggtacctgcccgccatcgtccgcgaggccatcaagcgggggctgcgcaccctgatcctcgcgccgacgcgcgtggtggccgccgagatggaggaggccctgcggggcctgcccatccgctaccagacccccgccatcaagaccgagcacaccgggcgggagatcgtcgacctcatgtgccacgcgacgttcaccatgcgcctgctgtcccccgtgcgggtgccgaactacaacctcatcatcatggacgaggcccacttcaccgaccccgccagcatcgccgcccgcggctacatcagcacccgggtcgagatgggcgaggcggccgggatcttcatgacggccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctgcggaagaacggcaagaaggtgatccagctgagccgcaagacgttcgactccgagtacgtgaagacccgggccaacgactgggacttcgtcgtgaccaccgacatcagcgagatgggcgccaacttcaaggcggagcgcgtgatcgacccccggcgctgcatgaagcccgtcatcctcacggacggggaggagcgggtgatcctggccggccccatgccggtgacccactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtcgacgccatcgacggcgagtaccgcctgcgcggggaggcccgcaagaccttcgtggacctcatgcggcgcggcgacctgcccgtgtggctggcctacaaggtcgccgcggaggggatcaactacgccgaccggaagtggtgcttcgacggcatcaagaacaaccagatcctcgaggagaacatggaggtggagatctggacgaaggagggggagcgcaagaagctgaagccgcggtggctggacgcccgcatctacagcgaccccctcgccctgaaggagttcaaggagttcgcggccggccggaagtccctgaccctcaacctgatcaccgagatgggccgcctgcccaccttcatgacgcagaaggcccggaacgccctcgacaacctggccgtgctgcacaccgcggaggccgggggccgcgcctacaaccacgccctcagcgagctgcccgagaccctggagaccctcctgctgctcacgctgctggccaccgtcaccgggggcatcttcctcttcctgatgtccggcaaggggatcggcaagatgaccctggggatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgcggccaccatggccaacgagatgggcttcctggagaagacgaagaaggacctcgggctgggcagcatcaccacccaggagtccgagagcaacatcctggacatcgacctccgcccggccagcgcctggaccctgtacgcggtggccacgaccttcgtgacccccatgctgcggcactccatcgagaacagctccgtcaacgtgagcctcaccgccatcgccaaccaggcgacggtgctgatgggcctggggaagggctggcccctctccaagatggacatcggggtccccctgctggccatcggctgctacagccaggtgaacccgatcaccctcaccgccgccctgctgctcctggtggcccactacgcgatcatcgggcccggcctgcaggccaaggccacccgcgaggcccagaagcgggccgcggccggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcgcaccacgtgggccctctgcgaggccctgaccctggccaccgggcccatctccaccctctgggagggcaaccccgggcggttctggaacacgaccatcgcggtgagcatggccaacatcttccgcggctcctacctggccggcgccgggctcctcttcagcatcatgaagaacaccacctccacgcgccggggcaccgggaacatcggcgagaccctgggcgagaagtggaagtcccgcctgaacgcgctcgggaagtccgagttccagatctacaagaagtccggcatccaggaggtcgaccggaccctggccaaggaggggatcaagcgcggcgagacggaccaccacgccgtgtcccgggggagcgccaagctgcgctggttcgtggagcggaacatggtcaccccggagggcaaggtggtggacctcggctgcgggcgcggcgggtggtcctactactgcggcgggctgaagaacgtccgggaggtgaagggcctgaccaagggcgggcccggccacgaggagcccatccccatgagcacctacgggtggaacctcgtgcgcctgcagtccggcgtcgacgtgttcttcacgccgcccgagaagtgcgacaccctgctctgcgacatcggggagagcagccccaaccccaccatcgaggccggccggaccctgcgcgtgctgaacctcgtcgagaactggctgaacaacaacaccaagttctgcatcaaggtgctgaacccgtacatgccctccgtgatcgagaagatggaggcgctccagcggaagtacggcggggccctggtccgcaaccccctgagccggaactccacgcacgagatgtactgggtgagcaacgccaccggcaacatcgtgtccagcgtcaacatgatctcccgcatgctgatcaaccggttcaccatgaagcacaagaaggccacctacgagccggacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcgtccagcatggtgaacggcgtcgtgcgcctgctcaccaagccctgggacgtggtcccgatggtgacccagatggccatgaccgacacgacccccttcgggcagcagcgcgtgttcaaggagaaggtcgacacccggacccaggagcccaaggagggcacgaagaagctgatgaagatcaccgccgagtggctgtggaaggagctcggcaagaagaagacgccccgcatgtgcacccgggaggagttcacgcgcaaggtgcggtccaacgccgccctgggggcgatcttcaccgacgagaacaagtggaagtccgcccgcgaggccgtggaggacggccggttctgggagctggtcgaccgcgagcggaacctccacctggaggggaagtgcgagacctgcgtgtacaacatgatgggcaagcgcgagaagaagctgggggagttcggcaaggccaagggctcccgggcgatctggtacatgtggctcggggcccgcttcctggagttcgaggccctgggcttcctcaacgaggaccactggttcagccgggggaactccctgagcggcgtggagggggagggcctgcaccgcctcggctacatcctgcgggacgtcagcaagaaggagggcggcgccatgtacgccgacgacaccgcggggtgggacacgcgcatcaccctggaggacctcaagaacgaggagatggtgaccaaccacatgaagggcgagcacaagaagctggccgaggccatcttcaagctgacctaccagaacaaggtcgtgcgggtgcagcgcccgacgccccgggggaccgtcatggacatcatctcccgccgggaccagcgcggcagcggccaggtggggacctacggcctcaacaccttcacgaacatggaggcccagctgatccgccagatggagggggagggcatcttcaagtccatccagcacctgaccgccaccgaggagatcgtggtccagaactggctcgcgcgggtgggccgcgagcggctgagccgcatggccatctccggggacgactgcgtggtcaagcccatcgacgaccggttcgccagcgccctgaccgccctcaacgacatgggcaaggtgcgcaaggacatccagcagtgggagccctcccgggggtggaacgactggacccaggtcccgttctgcagccaccacttccacgagctggtcatgaaggacggccgcgtgctggtggtcccctgccggaaccaggacgagctcatcgggcgcgcgcggatctcccagggcgccggctggagcctgaaggagaccgcctgcctggggaagtcctacgcccagatgtggaccctcatgtacttccaccgccgggacctgcgcctggccgcgaacgccatctgcagcgccgtgccctcccactgggtgcccaccagccggaccacgtggtccatccacgccaagcacgagtggatgaccaccgaggacatgctcgcggtctggaaccgcgtgtggatccaggagaacccgtggatggaggacaagacccccgtggagagctgggaggaggtcccctacctgggcaagcgggaggaccagtggtgcgggtccctgatcggcctcacgagccgcgccacctgggccaagaacatccagaccgccatcaaccaggtgcggagcctgatcgggaacgaggagtacaccgactacatgccctccatgaagcgcttccgccgggaggaggaggaggccggcgtgctgtggtga

SEQ ID NO: 9296 - RNA, 9876 nt, synthetic construct
  misc_feature 1..9876: note = derived and/or modified CDS sequence (opt1) from DENV-2__EU482635__SS-prME
  source 1..9876: mol_type = other RNA
accgcgggcgtcatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgtccgaggagcaggacaagcgcttcatctgcaagcacagcatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccactccggggaggagcacgccgtgggcaacgacaccgggaagcacggcaaggagatcaagatcaccccgcagagctccatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggctccaactggatccagaaggagacgctggtgaccttcaagaacccccacgcgaagaagcaggacgtcgtggtcctcgggagccaggagggcgccatgcacaccgccctgaccggggccacggagatccagatgagctccggcaacctcctgttcaccggccacctgaagtgccgcctgcggatggacaagctccagctgaaggggatgagctactccatgtgcaccggcaagttcaagatcgtgaaggagatcgccgagacccagcacgggacgatcgtgatccgcgtccagtacgagggcgacggcagcccctgcaagatccccttcgagatcaccgacctggagaagcggcacgtgctcgggcgcctgatcaccgtgaacccgatcgtcaccgagaaggactcccccgtgaacatcgaggcggagccgcccttcggcgacagctacatcatcatcggggtggagccgggccagctgaagctcaactggttcaagaaggggtccagcatcggccagatgttcgagacgaccatgcgcggcgccaagcggatggccatcctgggggacaccgcctgggacttcggctccctcggcggggtcttcaccagcatcgggaaggccctccaccaggtgttcggggcgatctacggcgccgccttctccggggtgagctggacgatgaagatcctgatcggcgtcatcatcacctggatcgggatgaactcccgcagcacctccctgagcgtgtccctggtgctcgtcggcgtggtgaccctgtacctgggggccatggtccaggcggacagcggctgcgtggtgtcctggaagaacaaggagctcaagtgcggcagcgggatcttcatcacggacaacgtccacacctggaccgagcagtacaagttccagcccgagagcccctccaagctggccagcgccatccagaaggcccacgaggagggcatctgcgggatccggtccgtgacccgcctggagaacctcatgtggaagcagatcacgcccgagctgaaccacatcctgagcgagaacgaggtgaagctcaccatcatgaccggcgacatccgggggatcatgcaggccggcaagcgctccctgcggccgcagcccaccgagctgaagtacagctggaagacgtggggcaaggcgaagatgctctccaccgagagccacaaccagaccttcctgatcgacgggcccgagaccgccgagtgcccgaacacgaaccgcgcctggaactccctggaggtcgaggactacggcttcggggtgttcaccaccaacatctggctcaagctgcgggagaagcaggacgtgttctgcgacagcaagctgatgtccgccgccatcaaggacaaccgcgcggtccacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgcctccgggaagctgatcacggagtggtgctgccgcagctgcaccctgcccccgctccggtaccgcggcgaggacgggtgctggtacggcatggagatccggcccctgaaggagaaggaggagaacctggtgaactccctcgtgaccgccgggcacggccagatcgacaacttcagcctgggcgtcctggggatggccctcttcctggaggagatgctgcgcacccggatcggcacgaagcacgcgatcctcctggtggccgtgtccttcgtcaccctgatcaccgggaacatgagcttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgacctccaaggagctgatgatggccacgatcggcatcgccctcctgagccagtccaccatccccgagaccatcctggagctcaccgacgcgctggccctggggatgatggtcctcaagatcgtgcggaacatggagaagtaccagctggccgtgacgatcatggccatcagctgcgtcccgaacgccgtgatcctgcagaacgcgtggaaggtgtcctgcaccatcctcgccgccgtcagcgtgagccccctgctgctcaccagctcccagcagaaggccgactggatccccctggcgctgaccatcaagggcctcaaccccacggccatcttcctgaccaccctgagccgcacctccaagaagcggagctggccgctcaacgaggccatcatggccgtcggcatggtgtccatcctggccagcagcctgctcaagaacgacatccccatgacggggcccctggtggcgggcgggctgctcaccgtctgctacgtgctgaccggccgctccgccgacctggagctcgagcgggccgccgacgtgaagtgggaggaccaggccgagatcagcgggtccagccccatcctgtccatcaccatcagcgaggacggctccatgagcatcaagaacgaggaggaggagcagacgctgaccatcctcatccgcaccggcctgctggtcatctccggggtgttcccggtgagcatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtacagccagatcggcgccggcgtgtacaaggaggggaccttccacacgatgtggcacgtgacccgcggcgccgtcctgatgcaccgggggaagcgcatcgagccctcctgggccgacgtgaagaaggacctgatcagctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgtccctcgacttcagccccggcacctccggcagccccatcgtcgaccgcaaggggaaggtggtgggcctgtacgggaacggcgtcgtgacccggtccggcgcctacgtgagcgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgtcccccgtgcgcgtgcccaactacaacctcatcatcatggacgaggcgcacttcaccgacccggccagcatcgccgcccggggctacatctccacgcgcgtcgagatgggcgaggccgcggggatcttcatgaccgccacgccgcccggcagccgggaccccttcccgcagtccaacgcccccatcatggacgaggagcgcgagatccccgagcggagctggaactccgggcacgagtgggtgaccgacttcaagggcaagacggtgtggttcgtccccagcatcaaggccgggaacgacatcgcggcctgcctgcgcaagaacggcaagaaggtgatccagctgtcccggaagaccttcgacagcgagtacgtgaagacccgcgccaacgactgggacttcgtcgtgaccacggacatctccgagatgggcgccaacttcaaggccgagcgggtgatcgacccgcgccggtgcatgaagcccgtcatcctcaccgacggggaggagcgcgtgatcctggcgggccccatgcccgtgacccacagctccgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatccccagcatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctactccgacccgctcgccctgaaggagttcaaggagttcgccgcgggccgcaagagcctgaccctcaacctgatcaccgagatgggccggctgcccacgttcatgacccagaaggcccgcaacgccctcgacaacctggccgtgctgcacaccgccgaggccggcgggcgggcctacaaccacgccctctccgagctgcccgagaccctggagacgctcctgctgctcaccctgctggccaccgtcaccggcgggatcttcctcttcctgatgagcgggaaggggatcggcaagatgaccctggggatgtgctgcatcatcacggcctccatcctcctgtggtacgcgcagatccagccccactggatcgccgccagcatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagtccgagagcaacatcctggacatcgacctccggcccgcctccgcctggacgctgtacgccgtggcgaccaccttcgtgaccccgatgctgcgccacagcatcgagaactccagcgtcaacgtgtccctcacggccatcgccaaccaggccaccgtgctgatgggcctggggaagggctggcccctcagcaagatggacatcggggtccccctgctggcgatcggctgctactcccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatcagcacgctctgggagggcaaccccgggcgcttctggaacaccaccatcgccgtgtccatggcgaacatcttccgcggcagctacctggccggcgccgggctcctgttctccatcatgaagaacaccacgagcacccggcgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgagcacgtacgggtggaacctcgtgcggctgcagtccggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacggcggggcgctggtccggaaccccctgtcccgcaacagcacccacgagatgtactgggtgtccaacgccaccggcaacatcgtgagctccgtcaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttcagccgcgggaactccctgagcggcgtggagggggagggcctgcaccggctcggctacatcctgcgcgacgtctccaagaaggagggcggcgccatgtacgccgacgacacggccgggtgggacacccggatcaccctggaggacctcaagaacgaggagatggtgaccaaccacatgaagggcgagcacaagaagctggcggaggccatcttcaagctgacgtaccagaacaaggtcgtgcgcgtgcagcggcccaccccgcgcgggaccgtcatggacatcatcagccggcgcgaccagcgcggctccggccaggtggggacctacggcctcaacacgttcaccaacatggaggcccagctgatccggcagatggagggggagggcatcttcaagagcatccagcacctgaccgccaccgaggagatcgccgtgcagaactggctcgcgcgcgtcggccgggagcgcctgtcccggatggccatcagcggggacgactgcgtggtgaagcccatcgacgaccgcttcgcctccgccctgacggccctcaacgacatgggcaaggtccggaaggacatccagcagtgggagcccagccgcgggtggaacgactggacccaggtgcccttctgctcccaccacttccacgagctggtgatgaaggacggccgggtcctggtggtgccgtgccgcaaccaggacgagctcatcgggcgggcgcgcatcagccagggcgccggctggtccctgaaggagaccgcctgcctgggcaagagctacgcccagatgtggaccctcatgtacttccaccggcgcgacctgcggctggccgcgaacgccatctgctccgccgtccccagccactgggtgcccacctcccgcacgacctggagcatccacgccaagcacgagtggatgaccaccgaggacatgctcgcggtgtggaaccgggtctggatccaggagaacccctggatggaggacaagacgccggtggagagctgggaggaggtgccctacctgggcaagcgcgaggaccagtggtgcgggtccctgatcggcctcaccagccgggccacctgggccaagaacatccagaccgccatcaaccaggtccgctccctgatcgggaacgaggagtacacggactacatgcccagcatgaagcgcttccggcgcgaggaggaggaggccggcgtgctgtggtga

SEQ ID NO: 9297 - RNA, 9876 nt, synthetic construct
  misc_feature 1..9876: note = derived and/or modified CDS sequence (opt1) from DENV-2__GQ199874__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccttcgtgaccccgatgctgcgccactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacgtacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacggcggggcgctggtccggaaccccctgtcccgcaacagcacccacgagatgtactgggtgtccaacgccaccggcaacatcgtgagctccgtcaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggcccaccccgcgcggcaccgtcatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtgcagaactggctcgcgcgcgtcgggcgggagcgcctgagccggatggccatctccggcgacgactgcgtggtgaagcccatcgacgaccgcttcgccagcgccctgacggccctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtcccctcccactgggtgcccaccagccgcacgacctggtccatccacgccaagcacgagtggatgaccaccgaggacatgctcgcggtgtggaaccgggtctggatccaggagaacccctggatggaggacaagacgccggtggagagctgggaggaggtgccctacctggggaagcgcgaggaccagtggtgcggctccctgatcgggctcaccagccgggccacctgggccaagaacatccagaccgccatcaaccaggtccgcagcctgatcggcaacgaggagtacacggactacatgccctccatgaagcgcttccggcgcgaggaggaggaggccggcgtgctgtggtga

SEQ ID NO: 9298 - RNA, 9876 nt, synthetic construct
  misc_feature 1..9876: note = derived and/or modified CDS sequence (opt1) from DENV-2__EU482639__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccctggtgaccccgatgctccgccactccatcgagaacagctccgtcaacgtgagcctgacggccatcgccaaccaggccaccgtgctgatgggcctcgggaagggctggcccctgtccaagatggacatcggggtccccctgctcgcgatcggctgctacagccaggtgaaccccatcaccctgaccgccgccctgctcctgctggtggcccactacgccatcatcgggccgggcctccaggcgaaggccacgcgggaggcccagaagcgcgccgccgcgggcatcatgaagaaccccaccgtcgacgggatcaccgtgatcgacctggagcccatcccctacgacccgaagttcgagaagcagctgggccaggtgatgctcctgatcctgtgcgtcacccaggtgctcatgatgcggacgacctgggccctgtgcgaggccctgaccctcgccaccgggcccatctccacgctgtgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctcaacgccctgggcaagagcgagttccagatctacaagaagtccggcatccaggaggtcgaccgcacgctggcgaaggaggggatcaagcggggcgagaccgaccaccacgccgtgagccgcgggtccgccaagctccggtggttcgtggagcgcaacatggtcacccccgagggcaaggtggtggacctgggctgcgggcggggcgggtggagctactactgcggcgggctgaagaacgtccgcgaggtgaagggcctcaccaagggcgggccgggccacgaggagcccatccccatgtccacgtacgggtggaacctggtgcggctgcagagcggcgtcgacgtgttcttcacgccgcccgagaagtgcgagaccctcctgtgcgacatcggggagagctcccccaaccccaccatcgaggccggccgcaccctgcgggtgctcaacctggtcgagaactggctgaacaacaacacgcagttctgcatcaaggtgctcaacccctacatgcccagcgtgatcgagaagatggaggccctgcagcgcaagtacggcggggcgctggtccggaaccccctgtcccgcaacagcacccacgagatgtactgggtgtccaacgccaccggcaacatcgtgagctccgtcaacatgatcagccggatgctcatcaaccgcttcaccatgaagcacaagaaggccacgtacgagcccgacgtggacctggggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctcctgaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctctggaaggagctgggcaagaagaagacgccccggatgtgcacgcgcgaggagttcacccggaaggtgcgcagcaacgccgccctgggggccatcttcaccgacgagaacaagtggaagtccgcgcgggaggccgtggaggacggccgcttctgggagctcgtcgaccgggagcgcaacctgcacctggaggggaagtgcgagacctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgggaacagcctgagcggcgtggagggggagggcctccaccggctgggctacatcctgcgcgacgtcgggaagaaggagggcggggccatgtacgccgacgacacggccggctgggacacccggatcaccctcgaggacctgaagaacgaggagatggtgaccaaccacatgaagggggagcacaagaagctggcggaggccatcttcaagctcacgtaccagaacaaggtcgtgcgcgtgcagcggcccaccccgcgcggcaccgtcatggacatcatctcccggcgcgaccagcgcggcagcgggcaggtcggcacctacgggctgaacacgttcaccaacatggaggcccagctgatccggcagatggagggcgagggcatcttcaagtccatccagcacctcaccgccaccgaggagatcgccgtgcagaactggctggcgcgcgtcgggcgggagcgcctgagccggatggccatctccggcgacgactgcgtggtgaagcccatcgacgaccgcttcgccagcgccctcacggccctgaacgacatggggaagatccggaaggacatccagcagtgggagccctcccgcggctggaacgactggacccaggtccccttctgcagccaccacttccacgagctggtgatgaaggacgggcgggtgctcgtcgtgccgtgccgcaaccaggacgagctgatcggccgggcgcgcatctcccagggcgccgggtggagcctgaaggagaccgcctgcctcggcaagtcctacgcccagatgtggaccctgatgtacttccaccggcgcgacctgcggctcgccgcgaacgccatctgcagcgccgtgccctcccactgggtccccaccagccgcacgacctggtccatccacgccaagcacgagtggatgaccaccgaggacatgctggcggtgtggaaccgggtgtggatccaggagaacccctggatggaggacaagacgccggtcgagagctgggaggaggtgccctacctggggaagcgcgaggaccagtggtgcggctccctcatcgggctgaccagccgggccacctgggccaagaacatccagaccgccatcaaccaggtgcgcagcctgatcggcaacgaggagtacacggactacatgccctccatgaagcgcttccggcgcgaggaggaggaggccggcgtcctctggtga

SEQ ID NO: 9299 - RNA, 9876 nt, synthetic construct
  misc_feature 1..9876: note = derived and/or modified CDS sequence (opt1) from DENV-2__EU482766__SS-prME
  source 1..9876: mol_type = other RNA
accgcgggcgtgatcgtcatgctgatccccaccgccatggcgttccacctcaccacccggaacggggagccccacatgatcgtgggccggcaggagaagggcaagagcctgctgttcaagaccgaggacggggtgaacatgtgcaccctcatggccatcgacctgggggagctgtgcgaggacaccatcacctacaagtgccccctcctgcgccagaacgagcccgaggacatcgactgctggtgcaactccaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgctccagccgcaccggcctcgacttcaacgagatggtcctgctgcagatggaggacaaggcctggctcgtgcaccggcagtggttcctggacctgcccctcccctggctgcccggggccgacacccagggctccaactggatccagaaggagacgctggtgaccttcaagaacccgcacgcgaagaagcaggacgtcgtggtcctcgggagccaggagggcgccatgcacaccgccctgaccggggccacggagatccagatgagctccggcaacctcctgttcaccggccacctgaagtgccgcctgcggatggacaagctccagctgaaggggatgagctactccatgtgcaccggcaagttcaagatcgtgaaggagatcgccgagacccagcacgggacgatcgtgatccgcgtccagtacgagggcgacggcagcccctgcaagatccccttcgagatcaccgacctggagaagcggcacgtgctcgggcgcctgatcaccgtgaaccccatcgtcaccgagaaggactccccggtgaacatcgaggcggagccgcccttcggcgacagctacatcatcatcggggtggagcccggccagctgaagctcaactggttcaagaaggggtccagcatcggccagatgttcgagacgaccatgcgcggcgccaagcggatggccatcctgggggacaccgcctgggacttcggctccctcgggggcgtcttcaccagcatcgggaaggccctccaccaggtgttcggcgcgatctacggcgccgccttctccggggtgagctggacgatgaagatcctgatcggcgtcatcatcacctggatcgggatgaactcccgcagcacctccctgagcgtgtccctggtgctcgtcggcgtggtgaccctgtacctgggggccgtcgtgcaggcggacagcggctgcgtggtctcctggaagaacaaggagctcaagtgcggcagcgggatcttcatcacggacaacgtgcacacctggaccgagcagtacaagttccagccggagagcccctccaagctggccagcgccatccagaaggcccacgaggagggcatctgcgggatccggtccgtgacccgcctggagaacctcatgtggaagcagatcacgcccgagctgaaccacatcctgagcgagaacgaggtcaagctcaccatcatgaccggcgacatcaaggggatcatgcaggccggcaagcggtccctgcgcccccagccgaccgagctgaagtacagctggaagacgtggggcaaggcgaagatgctctccaccgagagccacaaccagaccttcctgatcgacgggcccgagaccgccgagtgccccaacacgaaccgggcctggaactccctggaggtggaggactacggcttcggggtgttcaccaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggccgaagtcccacaccctgtggagcaacggcgtgctggagtccgagatgatcatccccaagaacttcgccgggcccgtgagccagcacaactaccgccccggctaccacacgcagaccgcggggccgtggcacctcggcaagctggagatggacttcgacttctgcgaggggaccaccgtggtcgtgacggaggactgcggcaaccggggccccagcctgcgcaccaccaccgcctccgggaagctcatcacggagtggtgctgccggagctgcaccctgccgcccctgcgctaccggggcgaggacgggtgctggtacggcatggagatccgcccgctcaaggagaaggaggagaacctggtgaactccctggtcaccgccgggcacggccagatcgacaacttcagcctcggcgtgctggggatggccctgttcctcgaggagatgctgcggacccgcatcggcacgaagcacgcgatcctgctcgtggccgtctccttcgtgaccctgatcaccgggaacatgagcttccgggacctgggccgcgtgatggtcatggtgggggccaccatgacggacgacatcggcatgggcgtgacctacctcgccctgctggccgcgttcaaggtccgccccaccttcgccgccgggctcctgctgcggaagctcacctccaaggagctgatgatggccacgatcggcatcgccctgctcagccagtccaccatccccgagaccatcctggagctgaccgacgcgctcgccctggggatgatggtgctgaagatcgtgcgcaacatggagaagtaccagctcgccgtcacgatcatggccatcagctgcgtgcccaacgccgtgatcctgcagaacgcgtggaaggtctcctgcaccatcctggccgccgtgagcgtctccccgctcctgctgaccagctcccagcagaaggccgactggatccccctcgcgctgaccatcaagggcctgaaccccacggccatcttcctcaccaccctgagccggacctccaagaagcgcagctggcccctgaacgaggccatcatggccgtgggcatggtgtccatcctcgccagcagcctgctgaagaacgacatcccgatgacggggcccctcgtcgcgggcgggctgctgaccgtgtgctacgtgctcaccggccggtccgccgacctggagctggagcgcgccgccgacgtcaagtgggaggaccaggccgagatcagcgggtccagccccatcctctccatcaccatcagcgaggacggctccatgagcatcaagaacgaggaggaggagcagacgctgaccatcctgatccggaccggcctcctggtgatctccggggtgttccccgtcagcatcccgatcaccgcggccgcctggtacctgtgggaggtgaagaagcagcgcgccggcgtgctctgggacgtccccagcccgccgcccgtggagaaggccgagctggaggacggggcgtaccggatcaagcagcgcggcatcctggggtacagccagatcggcgccggcgtgtacaaggaggggaccttccacacgatgtggcacgtcacccggggcgccgtgctcatgcaccgcgggaagcggatcgagccctcctgggccgacgtgaagaaggacctgatcagctacggcgggggctggaagctggagggcgagtggaaggagggggaggaggtccaggtgctcgccctggagcccggcaagaacccccgcgcggtgcagaccaagcccgggatcttcaagaccaacacgggcaccatcggggccgtctccctggacttcagccccggcacctccggcagccccatcgtggaccggaaggggaaggtggtcggcctctacgggaacggcgtggtgacccgctccggcgcctacgtcagcgccatcgcgcagacggagaagtccatcgaggacaacccggagatcgaggacgacatcttccggaagaagcgcctgaccatcatggacctgcaccccggggccggcaagaccaagcggtacctccccgccatcgtgcgcgaggccatcaagcgggggctgcgcaccctgatcctggcccccacgcgcgtggtcgcggccgagatggaggaggccctccggggcctgccgatccgctaccagacccccgccatcaagaccgagcacaccgggcgggagatcgtggacctgatgtgccacgccacgttcaccatgcgcctcctgtcccccgtgcgggtccccaactacaacctgatcatcatggacgaggcgcacttcaccgacccggccagcatcgccgcccgcggctacatctccacccgggtggagatgggcgaggccgcggggatcttcatgacggccacgccgcccggcagccgcgaccccttcccgcagtccaacgcccccatcatggacgaggagcgggagatccccgagcgcagctggaactccgggcacgagtgggtgaccgacttcaagggcaagaccgtctggttcgtgcccagcatcaaggccgggaacgacatcgcggcctgcctccggaagaacggcaagaaggtgatccagctgtcccgcaagacgttcgacagcgagtacgtcaagacccgggccaacgactgggacttcgtggtgaccaccgacatctccgagatgggcgccaacttcaaggccgagcgcgtcatcgacccgcggcgctgcatgaagcccgtgatcctgacggacggggaggagcgggtgatcctcgcgggccccatgcccgtcacccacagctccgccgcccagcgccgggggcgcatcggccgcaacccgaagaacgagaacgaccagtacatctacatgggggagcccctggagaacgacgaggactgcgcccactggaaggaggccaagatgctgctcgacaacatcaacacccccgagggcatcatccccagcatgttcgagccggagcgggagaaggtggacgcgatcgacggcgagtaccgcctgcgcggggaggcccgcaagaccttcgtggacctgatgcggcgcggcgacctccccgtctggctggcctacaaggtggccgccgaggggatcaactacgcggaccggaagtggtgcttcgacggcatcaagaacaaccagatcctggaggagaacatggaggtggagatctggacgaaggagggggagcgcaagaagctcaagccccggtggctggacgcccgcatctactccgacccgctggccctcaaggagttcaaggagttcgccgcgggccgcaagagcctgaccctgaacctcatcaccgagatgggccgcctgcccaccttcatgacgcagaaggcccggaacgccctggacaacctcgccgtcctgcacaccgccgaggccgggggccgcgcctacaaccacgccctgtccgagctccccgagaccctggagaccctgctcctgctgacgctcctggccaccgtgaccgggggcatcttcctgttcctcatgagcggcaaggggatcggcaagatgaccctggggatgtgctgcatcatcaccgcctccatcctgctctggtacgcgcagatccagccccactggatcgccgccagcatcatcctggagttcttcctgatcgtcctcctgatcccggagcccgagaagcagcggacgccccaggacaaccagctgacctacgtggtgatcgccatcctcaccgtcgtggccgcgaccatggccaacgagatgggcttcctggagaagacgaagaaggacctggggctcggcagcatcaccacccaggagtccgagagcaacatcctggacatcgacctgcgccccgcctccgcctggaccctctacgccgtggcgacgaccttcgtcaccccgatgctgcggcacagcatcgagaactccagcgtgaacgtgtccctgaccgccatcgccaaccaggccacggtcctcatgggcctggggaagggctggcccctgagcaagatggacatcggggtgcccctcctggcgatcggctgctactcccaggtgaaccccatcaccctgaccgccgccctcctgctgctcgtcgcccactacgccatcatcgggccgggcctgcaggcgaaggccacccgcgaggcccagaagcgggccgccgcgggcatcatgaagaaccccacggtggacgggatcaccgtgatcgacctggagcccatcccctacgacccgaagttcgagaagcagctcggccaggtcatgctgctgatcctctgcgtgacccaggtgctgatgatgcgcaccacgtgggccctgtgcgaggccctcaccctggccaccgggcccatcagcaccctgtgggagggcaaccccgggcggttctggaacacgaccatcgccgtctccatggcgaacatcttccgcggcagctacctcgccggcgccgggctgctgttctccatcatgaagaacaccaccagcacgcgccggggcaccgggaacatcggcgagaccctcggcgagaagtggaagtcccgcctgaacgccctgggcaagagcgagttccagatctacaagaagtccggcatccaggaggtggaccggaccctcgcgaaggaggggatcaagcgcggcgagacggaccaccacgccgtgagccgggggtccgccaagctgcgctggttcgtcgagcggaacatggtgacccccgagggcaaggtggtcgacctgggctgcgggcgcggcgggtggagctactactgcggcgggctcaagaacgtgcgggaggtgaagggcctgaccaagggcgggccgggccacgaggagcccatccccatgagcacctacgggtggaacctggtccgcctccagtccggcgtggacgtgttcttcacgcccccggagaagtgcgacaccctgctgtgcgacatcggggagagctcccccaaccccaccatcgaggccggccggaccctccgcgtcctgaacctggtggagaactggctcaacaacaacacccagttctgcatcaaggtgctgaacccctacatgccgagcgtcatcgagaagatggaggccctgcagcggcagtacggcggggcgctcgtgcgcaaccccctgtcccggaacagcacgcacgagatgtactgggtgtccaacgccaccggcaacatcgtcagctccgtgaacatgatcagccgcatgctgatcaaccggttcaccatgaagcacaagaaggccacctacgagcccgacgtggacctggggtccggcacgcgcaacatcgggatcgagagcgagatcccgaacctcgacatcatcggcaagcggatcgagaagatcaagcaggagcacgagatctcctggcactacgaccaggaccacccctacaagacctgggcctaccacggcagctacgagaccaagcagaccgggtccgccagctccatggtcaacggcgtggtgcgcctgctgacgaagccctgggacgtcgtgcccatggtgacccagatggcgatgaccgacaccacgccgttcgggcagcagcgcgtcttcaaggagaaggtggacacccggacccaggagcccaaggagggcaccaagaagctcatgaagatcacggccgagtggctgtggaaggagctgggcaagaagaagacgccccggatgtgcacccgggaggagttcacccgcaaggtgcggagcaacgccgccctcggggccatcttcacggacgagaacaagtggaagtccgcgcgcgaggccgtcgaggacggccggttctgggagctggtggaccgcgagcggaacctgcacctcgaggggaagtgcgagacctgcgtgtacaacatgatgggcaagcgcgagaagaagctgggggagttcggcaaggccaagggcagccgggccatctggtacatgtggctgggggcgcgcttcctcgagttcgaggccctgggcttcctgaacgaggaccactggttcagccgggggaactccctcagcggcgtcgagggggagggcctgcaccgcctgggctacatcctccgggacgtggggaagaaggagggcggggccatgtacgccgacgacaccgccggctgggacacccgcatcacgctggaggacctgaagaacgaggagatggtcaccaaccacatgaagggggagcacaagaagctcgcggaggccatcttcaagctgacctaccagaacaaggtggtgcgggtccagcgccccaccccgcggggcacggtgatggacatcatctcccgccgggaccagcgcggcagcgggcaggtcggcacctacgggctgaacaccttcaccaacatggaggcccagctcatccgccagatggagggcgagggcatcttcaagtccatccagcacctgacggccaccgaggagatcgccgtccagaactggctggcgcgggtggggcgcgagcggctcagccgcatggccatctccggcgacgactgcgtggtcaagcccatcgacgaccggttcgccagcgccctgaccgccctgaacgacatggggaaggtgcgcaaggacatccagcagtgggagccctcccggggctggaacgactggacccaggtgcccttctgcagccaccacttccacgagctcgtcatgaaggacgggcgcgtgctggtggtcccgtgccggaaccaggacgagctgatcggccgcgcgcggatctcccagggcgccgggtggagcctcaaggagacggcctgcctgggcaagtcctacgcccagatgtggaccctgatgtacttccaccgccgggacctccgcctggccgcgaacgccatctgcagcgccgtgccctcccactgggtgcccaccagccggaccacctggtccatccacgccaagcacgagtggatgacgaccgaggacatgctggcggtctggaaccgcgtgtggatccaggagaacccctggatggaggacaagaccccggtggagagctgggaggaggtcccctacctcgggaagcgggaggaccagtggtgcggcagcctgatcgggctgacctcccgcgccacgtgggccaagaacatccagaccgccatcaaccaggtgcggagcctcatcggcaacgaggagtacaccgactacatgccctccatgaagcgcttccgccgggaggaggaggaggccggcgtgctgtggtga

SEQ ID NO: 9300 - RNA, 9876 nt, synthetic construct
  misc_feature 1..9876: note = derived and/or modified CDS sequence (opt1) from DENV-2__EU482695__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccttcgtgaccccgatgctgcgccactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacgtacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacggcggggcgctggtccggaaccccctgtcccgcaacagcacccacgagatgtactgggtgtccaacgccaccggcaacatcgtgagctccgtcaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggcccaccccgcgcggcaccgtcatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtgcagaactggctcgcgcgcgtcgggcgggagcgcctgagccggatggccatctccggcgacgactgcgtggtgaagcccatcgacgaccgcttcgccagcgccctgacggccctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtcccctcccactgggtgcccaccagccgcacgacctggtccatccacgccaagcacgagtggatgaccaccgaggacatgctcgcggtgtggaaccgggtctggatccaggagaacccctggatggaggacaagacgccggtggagagctgggaggaggtgccctacctggggaagcgcgaggaccagtggtgcggctccctgatcgggctcaccagccgggccacctgggccaagaacatccagaccgccatcaaccaggtccgcagcctgatcggcaacgaggagtacacggactacatgccctccatgaagcgcttccggcgcgaggaggaggaggccggcgtgctgtggtga

SEQ ID NO: 9301 - RNA, 9876 nt, synthetic construct
  misc_feature 1..9876: note = derived and/or modified CDS sequence (opt1) from DENV-2__EU482769__SS-prME
  source 1..9876: mol_type = other RNA
accgcgggcgtgatcgtcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcacggacaacgtccacacctggaccgagcagtacaagttccagcccgagagccccagcaagctggcctccgccatccagaaggcccacgaggagggcatctgcgggatccggagcgtgacccgcctggagaacctcatgtggaagcagatcacgcccgagctgaaccacatcctgtccgagaacgaggtgaagctcaccatcatgaccggcgacatccgggggatcatgcaggccggcaagcgcagcctgcggccgcagcccaccgagctgaagtactcctggaagacgtggggcaaggcgaagatgctcagcaccgagtcccacaaccagaccttcctgatcgacgggcccgagaccgccgagtgcccgaacacgaaccgcgcctggaacagcctggaggtcgaggactacggcttcggggtgttcaccaccaacatctggctcaagctgcgggagaagcaggacgtgttctgcgactccaagctgatgagcgccgccatcaaggacaaccgcgcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccggccgggctaccacacgcagaccgcggggccctggcacctcggcaagctggagatggacttcgacctgtgcgaggggaccaccgtggtggtcacggaggactgcggcaaccgcggccccagcctccggaccaccaccgccagcgggaagctgatcacggagtggtgctgccgctcctgcaccctgcccccgctccggtaccgcggcgaggacgggtgctggtacggcatggagatccggcccctgaaggagaaggaggagaacctggtgaacagcctcgtgaccgccgggcacggccagatcgacaacttctccctgggcgtcctggggatggccctcttcctggaggagatgctgcgcacccggatcggcacgaagcacgcgatcctcctggtggccgtgagcttcgtcaccctgatcaccgggaacatgtccttccgcgacctcggccgcgtgatggtgatggtcggggccaccatgacggacgacatcggcatgggcgtgacctacctggccctgctcgccgcgttcaaggtgcggcccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcatcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgaggacaaccccgagatcgaggacgacatcttccgcaagaagcggctgaccatcatggacctccaccccggggccggcaagaccaagcgctacctgcccgccatcgtccgggaggccatcaagcgcgggctgcgcaccctgatcctcgccccgacgcgggtggtggcggccgagatggaggaggccctgcgcggcctgcccatccggtaccagaccaccgccatcaagaccgagcacacggggcgcgagatcgtcgacctcatgtgccacgccaccttcaccatgcggctgctgagccccgtgcgcgtgcccaactacaacctcatcatcatggacgaggcgcacttcaccgacccggcctccatcgccgcccggggctacatcagcacgcgcgtcgagatgggcgaggccgcggggatcttcatgaccgccacgccgcccggctcccgggaccccttcccgcagagcaacgcccccatcatggacgaggagcgcgagatccccgagcggtcctggaacagcgggcacgagtgggtgaccgacttcaagggcaagacggtgtggttcgtcccctccatcaaggccgggaacgacatcgcggcctgcctgcgcaagaacggcaagaaggtgatccagctgagccggaagaccttcgactccgagtacgtgaagacccgcgccaacgactgggacttcgtcgtgaccacggacatcagcgagatgggcgccaacttcaaggccgagcgggtgatcgacccgcgccggtgcatgaagcccgtcatcctcaccgacggggaggagcgcgtgatcctggcgggccccatgcccgtgacccactccagcgccgcccagcggcgcgggcgcatcggccggaacccgaagaacgagaacgaccagtacatctacatgggggagcccctggagaacgacgaggactgcgcccactggaaggaggccaagatgctcctggacaacatcaacacccccgagggcatcatcccctccatgttcgagccggagcgcgagaaggtcgacgcgatcgacggcgagtaccggctgcgcggggaggcccggaagacgttcgtggacctcatgcgccggggcgacctgcccgtgtggctggcctacaaggtcgccgccgaggggatcaactacgcggaccgcaagtggtgcttcgacggcatcaagaacaaccagatcctcgaggagaacatggaggtggagatctggaccaaggagggggagcggaagaagctgaagccccgctggctggacgcccggatctacagcgacccgctcgccctgaaggagttcaaggagttcgccgcgggccgcaagtccctgaccctcaacctgatcaccgagatgggccggctgcccacgttcatgacccagaaggcccgcaacgccctcgacaacctggccgtgctgcacaccgccgaggccgggggccgggcctacaaccacgccctcagcgagctgcccgagaccctggagacgctcctgctgctcaccctgctggccaccgtcaccgggggcatcttcctcttcctgatgtccggcaaggggatcggcaagatgaccctggggatgtgctgcatcatcacggccagcatcctcctgtggtacgcgcagatccagccccactggatcgccgcctccatcatcctggagttcttcctcatcgtgctgctgatcccggagcccgagaagcagcgcacgccccaggacaaccagctcacctacgtcgtgatcgccatcctgaccgtggtcgccgcgacgatggccaacgagatgggcttcctggagaagaccaagaaggacctcgggctgggcagcatcaccacccaggagagcgagtccaacatcctggacatcgacctccggcccgccagcgcctggacgctgtacgccgtggcgaccaccttcgtgaccccgatgctgcgccactccatcgagaacagctccgtcaacgtgagcctcacggccatcgccaaccaggccaccgtgctgatgggcctggggaagggctggcccctctccaagatggacatcggggtccccctgctggcgatcggctgctacagccaggtgaaccccatcaccctcaccgccgccctgctgctcctggtggcccactacgccatcatcgggccgggcctgcaggcgaaggccacgcgggaggcccagaagcgcgccgccgcgggcatcatgaagaaccccaccgtcgacgggatcaccgtgatcgacctcgagcccatcccctacgacccgaagttcgagaagcagctgggccaggtgatgctgctcatcctgtgcgtcacccaggtgctgatgatgcggacgacctgggccctctgcgaggccctgaccctggccaccgggcccatctccacgctctgggagggcaaccccgggcgcttctggaacaccaccatcgccgtgagcatggcgaacatcttccgcggctcctacctggccggcgccgggctcctgttcagcatcatgaagaacaccacgaacacccggcgcggcaccgggaacatcggcgagaccctgggcgagaagtggaagtcccggctgaacgccctcggcaagagcgagttccagatctacaagaagtccggcatccaggaggtcgaccgcacgctggcgaaggaggggatcaagcggggcgagaccgaccaccacgccgtgagccgcgggtccgccaagctgcggtggttcgtggagcgcaacatggtcacccccgagggcaaggtggtggacctcggctgcgggcggggcgggtggagctactactgcggcgggctgaagaacgtccgcgaggtgaagggcctgaccaagggcgggccgggccacgaggagcccatccccatgtccacgtacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacgcagttctgcatcaaggtgctgaacccctacatgcccagcgtgatcgagaagatggaggccctccagcgcaagtacggcggggcgctggtccggaaccccctgtcccgcaacagcacccacgagatgtactgggtgtccaacgccaccggcaacatcgtgagctccgtcaacatgatcagccggatgctgatcaaccgcttcaccatgaagcacaagaaggccacgtacgagcccgacgtggacctcgggtccggcacccggaacatcgggatcgagagcgagatcccgaacctggacatcatcggcaagcgcatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtccccatggtgacccagatggcgatgacggacaccaccccgttcgggcagcagcgggtgttcaaggagaaggtcgacacccgcacgcaggagcccaaggagggcaccaagaagctgatgaagatcaccgccgagtggctgtggaaggagctcggcaagaagaagacgccccggatgtgcacgcgcgaggagttcacccggaaggtgcgcagcaacgccgccctgggggccatcttcaccgacgagaacaagtggaagtccgcgcgggaggccgtggaggacggccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcaccggctcggctacatcctgcgcgacgtcgggaagaaggagggcggggccatgtacgccgacgacacggccggctgggacacccggatcaccctggaggacctcaagaacgaggagatggtgaccaaccacatgaagggggagcacaagaagctggcggaggccatcttcaagctgacgtaccagaacaaggtcgtgcgcgtgcagcggcccaccccgcgcggcaccgtcatggacatcatctcccggcgcgaccagcgcggcagcgggcaggtcggcacctacgggctcaacacgttcaccaacatggaggcccagctgatccggcagatggagggcgagggcatcttcaagtccatccagcacctgaccgccaccgaggagatcgccgtgcagaactggctcgcgcgcgtcgggcgggagcgcctgagccggatggccatctccggcgacgactgcgtggtgaagcccatcgacgaccgcttcgccagcgccctgacggccctcaacgacatggggaaggtccggaaggacatccagcagtgggagccctcccgcggctggaacgactggacccaggtgcccttctgcagccaccacttccacgagctggtgatgaaggacgggcgggtcctggtggtgccgtgccgcaaccaggacgagctcatcggccgggcgcgcatctcccagggcgccgggtggagcctgaaggagaccgcctgcctgggcaagtcctacgcccagatgtggaccctcatgtacttccaccggcgcgacctgcggctggccgcgaacgccatctgcagcgccgtcccctcccactgggtgcccaccagccgcacgacctggtccatccacgccaagcacgagtggatgaccaccgaggacatgctcgcggtgtggaaccgggtctggatccaggagaacccctggatggaggacaagacgccggtggagagctgggaggaggtgccctacctggggaagcgcgaggaccagtggtgcggctccatgatcgggctgaccagccgggccacctgggccaagaacatccagaccgccatcaaccaggtccgcagcctcatcggcaacgaggagtacatcgactacatgccctccatgaagcgcttccggcgcgaggaggaggaggccggcgtgctgtggtga

SEQ ID NO: 9302 - RNA, 9876 nt, synthetic construct
  misc_feature 1..9876: note = derived and/or modified CDS sequence (opt1) from DENV-2__EU482696__SS-prME
  source 1..9876: mol_type = other RNA
accgcgggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggcagctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacagccccgtgaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtcttcacctccatcgggaaggccctccaccaggtgttcggcgcgatctacggcgccgccttcagcggggtgtcctggacgatgaagatcctgatcggcgtcatcatcacctggatcgggatgaacagccgctccaccagcctgtccgtgagcctggtgctcgtcggcgtggtgaccctgtacctgggggccatggtccaggcggactccggctgcgtggccagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggcgggcaagcggagcctgcgcccgcagcccaccgagctgaagtactcctggaagacgtggggcaaggccaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgcgatcaaggacaaccgggccgtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgcggggcccgtgtcccagcacaactaccgcccgggctaccacacgcagaccgccgggccctggcacctcggcaagctggagatggacttcgacctgtgcgaggggaccaccgtcgtggtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctgttcctggaggagatgctgcggacccgcatcggcacgaagcacgccaccctcctggtcgccgtgagcttcgtgaccctgatcaccgggaacatgtccttccgggacctcggccgcgtcatggtgatggtgggggccacgatgaccgacgacatcggcatgggcgtcacctacctggccctgctcgcggccttcaaggtgcgccccaccttcgccgccgggctgctgctccggaagctgacgagcaaggagctgatgatggccaccatcggcatcgcgctcctgtcccagagcaccatccccgagaccatcctggagctcacggacgccctggccctggggatgatggtgctcaagatcgtccgcaacatggagaagtaccagctggccgtgaccatcatggccatctcctgcgtgccgaacgcggtcatcctgcagaacgcctggaaggtgagctgcaccatcctcgccgccgtgtccgtcagccccctgctgctcacctccagccagcagaaggcggactggatccccctggccctgacgatcaagggcctcaaccccaccgccatcttcctgaccaccctgtcccggacgagcaagaagcgctcctggccgctcaacgaggccatcatggccgtgggcatggtcagcatcctggcgtccagcctgctcaagaacgacatccccatgaccgggcccctggtggccggcgggctgctcaccgtgtgctacgtcctgaccggccggagcgccgacctggagctcgagcgcgccgccgacgtgaagtgggaggaccaggcggagatctccgggagctcccccatcctgagcatcacgatctccgaggacggcagcatgtccatcaagaacgaggaggaggagcagaccctgaccatcctcatccggaccggcctgctggtgatcagcggggtcttcccggtgtccatccccatcaccgccgccgcctggtacctctgggaggtgaagaagcagcgcgccggcgtcctgtgggacgtgcccagcccgccgcccgtggagaaggcggagctggaggacggggcctaccggatcaagcagcgcggcatcctcgggtactcccagatcggcgccggcgtctacaaggaggggacgttccacaccatgtggcacgtgacccggggcgccgtgctgatgcaccgcgggaagcggatcgagcccagctgggccgacgtcaagaaggacctgatctcctacggcgggggctggaagctcgagggcgagtggaaggagggggaggaggtccaggtgctggcgctggagcccggcaagaacccccgcgccgtccagaccaagcccgggacgttcaagaccaacaccggcaccatcggggccgtgagcctcgacttctcccccggcacgagcggctcccccatcgtggaccggaaggggaaggtcgtgggcctgtacgggaacggcgtggtcacccgcagcggcgcctacgtgtccgcgatcgcccagaccgagaagtccatcgaggacaaccccgagatcgaggacgacatcttccggaagaagcgcctgaccatcatggacctccaccccggggccggcaagacgaagcggtacctgcccgccatcgtgcgcgaggccatcaagcgggggctgcgcaccctgatcctcgcgccgacccgcgtcgtggccgccgagatggaggaggccctgcggggcctgcccatccgctaccagacccccgccatcaagacggagcacaccgggcgggagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggcgaggcggccgggatcttcatgaccgccacgccgcccggctcccgcgacccgttcccccagagcaacgcccccatcatggacgaggagcgggagatccccgagcgctcctggaacagcgggcacgagtgggtcacggacttcaagggcaagaccgtgtggttcgtgccgtccatcaaggcggggaacgacatcgccgcctgcctgcggaagaacggcaagaaggtcatccagctgagccgcaagaccttcgactccgagtacgtgaagacccgggccaacgactgggacttcgtggtcacgaccgacatcagcgagatgggcgccaacttcaaggcggagcgcgtgatcgacccccggcgctgcatgaagcccgtgatcctcaccgacggggaggagcgggtcatcctggccggccccatgccggtgacccactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacgcccgagggcatcatcccgtccatgttcgagcccgagcgggagaaggtggacgccatcgacggcgagtaccgcctgcgcggggaggcccgcaagaccttcgtcgacctcatgcggcgcggcgacctgcccgtgtggctggcctacaaggtggccgcggaggggatcaactacgccgaccggaagtggtgcttcgacggcatcaagaacaaccagatcctcgaggagaacatggaggtcgagatctggaccaaggagggggagcgcaagaagctgaagccgcggtggctggacgcccgcatctacagcgaccccctcgccctgaaggagttcaaggagttcgcggccggccggaagtccctgaccctcaacctgatcacggagatgggccgcctgcccaccttcatgacccagaaggcccggaacgccctcgacaacctggccgtgctgcacaccgcggaggccgggggccgcgcctacaaccacgccctcagcgagctgcccgagacgctggagaccctcctgctgctcaccctgctggccaccgtgaccgggggcatcttcctcttcctgatgtccggcaaggggatcggcaagatgacgctggggatgtgctgcatcatcaccgcgagcatcctcctgtggtacgcccagatccagccgcactggatcgccgcctccatcatcctggagttcttcctcatcgtcctgctgatccccgagcccgagaagcagcggacgccccaggacaaccagctcacctacgtggtcatcgccatcctgacggtggtggcggccaccatggccaacgagatgggcttcctggagaagaccaagaaggacctcgggctgggcagcatcaccacgcaggagagcgagtccaacatcctggacatcgacctccgcccggccagcgcctggaccctgtacgcggtcgccaccaccttcgtgacgcccatgctgcggcactccatcgagaacagctccgtgaacgtcagcctcaccgccatcgccaaccaggcgaccgtgctgatgggcctggggaagggctggcccctctccaagatggacatcggggtgcccctgctggccatcggctgctacagccaggtcaacccgatcaccctcacggccgccctgctgctcctggtggcccactacgcgatcatcgggcccggcctgcaggccaaggccacccgcgaggcccagaagcgggccgcggccggcatcatgaagaaccccaccgtggacgggatcaccgtcatcgacctcgagcccatcccgtacgaccccaagttcgagaagcagctgggccaggtgatgctgctcatcctgtgcgtgacgcaggtcctgatgatgcgcaccacctgggccctctgcgaggccctgaccctggccacggggcccatctccaccctctgggagggcaaccccgggcggttctggaacaccaccatcgcggtgagcatggccaacatcttccgcggctcctacctggccggcgccgggctcctcttcagcatcatgaagaacacgacctccacccgccggggcaccgggaacatcggcgagacgctgggcgagaagtggaagtcccgcctgaacgcgctcgggaagtccgagttccagatctacaagaagtccggcatccaggaggtggaccggaccctggccaaggaggggatcaagcgcggcgagaccgaccaccacgccgtctcccgggggagcgccaagctgcgctggttcgtggagcggaacatggtgaccccggagggcaaggtcgtggacctcggctgcgggcgcggcgggtggtcctactactgcggcgggctgaagaacgtgcgggaggtcaagggcctgacgaagggcgggcccggccacgaggagcccatccccatgagcacctacgggtggaacctcgtgcgcctgcagagcggcgtggacgtcttcttcaccccgcccgagaagtgcgacaccctgctctgcgacatcggggagtccagccccaaccccaccatcgaggccggccggacgctgcgcgtgctgaacctcgtggagaactggctgaacaacaacacccagttctgcatcaaggtcctgaacccgtacatgccctccgtgatcgagaagatggaggcgctccagcggaagtacggcggggccctggtgcgcaaccccctgagccggaactccacccacgagatgtactgggtcagcaacgccaccggcaacatcgtgtccagcgtgaacatgatctcccgcatgctgatcaaccggttcacgatgaagcacaagaaggccacctacgagccggacgtcgacctcgggagcggcacccgcaacatcgggatcgagtccgagatccccaacctggacatcatcggcaagcggatcgagaagatcaagcaggagcacgagaccagctggcactacgaccaggaccacccctacaagacgtgggcctaccacggctcctacgagaccaagcagaccgggagcgcgtccagcatggtgaacggcgtggtccgcctgctcaccaagccctgggacgtggtgccgatggtcacgcagatggccatgaccgacaccacccccttcgggcagcagcgcgtgttcaaggagaaggtggacacgcggacccaggagcccaaggagggcaccaagaagctgatgaagatcaccgccgagtggctgtggaaggagctcggcaagaagaagacgccccgcatgtgcacccgggaggagttcacccgcaaggtccggtccaacgccgccctgggggcgatcttcaccgacgagaacaagtggaagtccgcccgcgaggccgtggaggacggccggttctgggagctggtggaccgcgagcggaacctccacctggaggggaagtgcgagacgtgcgtctacaacatgatgggcaagcgcgagaagaagctgggggagttcggcaaggccaagggctcccgggcgatctggtacatgtggctcggggcccgcttcctggagttcgaggccctgggcttcctcaacgaggaccactggttcagccgggggaacagcctgtccggcgtggagggggagggcctgcaccgcctcggctacatcctgcgggacgtgagcaagaaggagggcggcgccatgtacgccgacgacaccgcggggtgggacacccgcatcaccctggaggacctcaagaacgaggagatggtcacgaaccacatgaagggcgagcacaagaagctggccgaggccatcttcaagctgacctaccagaacaaggtggtccgggtgcagcgcccgacgccccgggggatcgtgatggacatcatctcccgccgggaccagcgcggcagcggccaggtcgggacctacggcctcaacacgttcaccaacatggaggcccagctgatccgccagatggagggggagggcatcttcaagtccatccagcacctgaccgccgcggaggagatcgtggtgcagaactggctcgcccgggtcggccgcgagcggctgagccgcatggccatctccggggacgactgcgtggtgaagcccatcgacgaccggttcgccagcgccctgaccgcgctcaacgacatgggcaaggtccgcaaggacatccagcagtgggagccctcccgggggtggaacgactggacccaggtgccgttctgcagccaccacttccacgagctggtgatgaaggacggccgcgtcctggtggtgccctgccggaaccaggacgagctcatcgggcgcgcccggatctcccagggcgccggctggagcctgaaggagaccgcctgcctggggaagtcctacgcccagatgtggaccctcatgtacttccaccgccgggacctgcgcctggcggccaacgccatctgcagcgccgtcccctcccactgggtgcccaccagccggaccacgtggtccatccacgcgaagcacgagtggatgaccaccgaggacatgctcgccgtgtggaaccgcgtctggatccaggagaacccgtggatggaggacaagacccccgtggagagctgggaggaggtgccctacctgggcaagcgggaggaccagtggtgcgggagcctgatcggcctcacgtcccgcgccacctgggccaagaacatccagaccgccatcaaccaggtccggagcctgatcgggaacgaggagtacaccgactacatgccctccatgaagcgcttccgccgggaggaggaggaggcgggcgtgctgtggtga

SEQ ID NO: 9303 - RNA, 9876 nt, synthetic construct
  misc_feature 1..9876: note = derived and/or modified CDS sequence (opt1) from DENV-2__KC294207__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctactgcatgtgcaccggcaagttcaagatcgtcaaggagatcgccgagacgcagcacgggaccatcgtgatccgcgtgcagtacgagggcgacggcagcccctgcaagatccccttcgagatcaccgacctggagaagcggcacgtcctcgggcgcctgatcaccgtgaacccgatcgtgacggagaaggactcccccgtcaacatcgaggcggagccgcccttcggcgacagctacatcatcgtgggggtggagccgggccagctgaagctcaactggttcaagaaggggtccagcatcggccagatgttcgagaccaccatgcgcggcgccaagcggatggccatcctgggggacaccgcctgggacttcggctccctcgggggcgtcttcacgagcatcgggaaggccctccaccaggtgttcggcgcgatctacggcgccgccttctccggggtgagctggaccatgaagatcctgatcggcgtcatcatcacctggatcgggatgaactcccgcagcacctccctgagcgtgtccctggtgctcgtcggcgtggtgacgctgtacctgggggccatggtccaggcggacagcggctgcatcgtgtcctggaagaacaaggagctcaagtgcggcagcgggatcttcatcaccgacaacgtgcacacctggaccgagcagtacaagttccagcccgagtcccccagcaagctggccagcgccatccagaaggcccacgaggagggcatctgcgggatccggtccgtcacgcgcctggagaacctcatgtggaagcagatcacccccgagctgaaccacatcctgagcgagaacgaggtgaagctcaccatcatgaccggcgacatcaaggggatcatgcaggccggcaagcggtccctgcgcccgcagcccacggagctgaagtacagctggaagacctggggcaaggcgaagatgctctccaccgagagccacaaccagaccttcctgatcgacgggcccgagacggccgagtgcccgaacaccaaccgggcctggaactccctggaggtggaggactacggcttcggggtcttcaccaccaacatctggctcaagctgcgcgagaagcaggacgtgttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacacgctgtggagcaacggcgtgctggagtccgagatgatcatccccaagaacttcgccgggcccgtgagccagcacaactaccgcccgggctaccacacccagaccgcggggcccggccacctcgggaagctggagatggacttcgacctgtgcgagggcaccacggtcgtggtgaccgaggactgcggcaaccgggggccctccctccgcaccaccacggccagcggcaagctgatcaccgagtggtgctgccggagctgcaccctgcccccgctccgctaccgcggggaggacggctgctggtacgggatggagatccgccccctgaaggagaaggaggagaacctggtcaactccctcgtgaccgccggccacggccagatcgacaacttcagcctgggggtgctgggcatggccctcttcctggaggagatgctgcggacgcgcgtcgggaccaagcacgcgatcctcctggtggccctgtccttcgtgaccctcatcaccggcaacatgagcttccgggacctggggcgcgtcatggtgatggtgggcgccacgatgaccgacgacatcggcatgggggtcacctacctggccctcctggccgcgttcaaggtgcgccccaccttcgccgccggcctgctcctgcggaagctgacgtccaaggagctcatgatggccaccatcgggatcgccctgctgagccagtccaccctccccgagaccatcctggagctgacggacgcgctcgccctgggcatgatggccctgaagatcgtgcgcaacatggagaagtaccagctcgccgtcaccatcatggccatcagctgcgtgccgaacgcggtgatcctgcagaacgcctggaaggtctcctgcaccatcctggccgccgtgagcgtgagccccctcctgctgaccagctcccagcagaaggcggactggatccccctcgccctgacgatcaagggcctgaaccccaccgccatcttcctcaccaccctgagccggacgtccaagaagcgcagctggccgctgaacgaggccatcatggccgtcgggatggtgtccatcctcgcgagctccctgctgaagaacgacatccccatgaccggccccctcgtcgccgggggcctgctgaccgtgtgctacgtgctcaccgggcggagcgccgacctggagctggagcgcgccgccgacgtcaagtgggaggaccaggcggagatcagcggctccagccccatcctctccatcacgatcagcgaggacggctccatgagcatcaagaacgaggaggaggagcagaccctgaccatcctgatccggaccgggctcctggtgatctccggcgtgttcccggtcagcatccccatcaccgccgccgcctggtacctgtgggaggtgaagaagcagcgcgccggggtgctctgggacgtccccagcccgccgcccgtgggcaaggcggagctggaggacggggcctaccggatcaagcagcgcggcatcctgggctacagccagatcggggccggcgtgtacaaggaggggacgttccacaccatgtggcacgtcacccggggcgccgtgctcatgcaccgcgggaagcggatcgagccctcctgggccgacgtgaagaaggacctgatcagctacggcggcgggtggaagctggagggcgagtggaaggagggggaggaggtccaggtgctcgcgctggagcccggcaagaacccccgcgccgtgcagaccaagcccgggatcttcaagacgaacaccggcaccatcggcgccgtctccctggacttcagccccgggacctccggcagccccatcgtggaccggaaggggaaggtggtcggcctctacggcaacggggtggtgacgcgctccggcgcctacgtcagcgcgatcgcccagaccgagaagtccatcgaggacaaccccgagatcgaggacgacatcttccggaagaagcgcctgaccatcatggacctgcaccccggggccggcaagaccaagcggtacctgcccgccatcgtgcgcgaggccatcaagcgggggctccgcacgctgatcctggcgccgacccgcgtggtcgccgccgagatggaggaggccctccggggcctgcccatccgctaccagacccccgccatccgggcggagcacaccggccgcgagatcgtggacctgatgtgccacgccacgttcaccatgcggctcctgagccccgtgcgcgtcccgaactacaacctgatcatcatggacgaggcccacttcaccgaccccgccagcatcgccgcgcgggggtacatctccacccgcgtggagatgggcgaggccgccgggatcttcatgacggccacgccgcccggcagccgggacccgttcccccagtccaacgcgcccatcatggacgaggagcgcgagatccccgagcggagctggaactccgggcacgagtgggtgaccgacttcaagggcaagaccgtctggttcgtgccgagcatcaaggccggcaacgacatcgccgcctgcctccgcaagaacgggaagaaggtgatccagctgtcccggaagacgttcgacagcgagtacgtcaagacccgcgccaacgactgggacttcgtggtgaccaccgacatctccgagatgggcgcgaacttcaaggccgagcgggtcatcgacccccgccggtgcatgaagcccgtgatcctgacggacggggaggagcgcgtgatcctcgccggccccatgccggtcacccacagctccgccgcccagcggcgcgggcgcatcggccggaaccccaagaacgagaacgaccagtacatctacatgggcgagcccctggagaacgacgaggactgcgcgcactggaaggaggccaagatgctgctcgacaacatcaacacccccgaggggatcatcccgagcatgttcgagcccgagcgcgagaaggtggacgccatcgacggcgagtaccggctgcgcggggaggcccggaagaccttcgtggacctgatgcgccggggcgacctccccgtctggctggcctacaaggtggcggccgaggggatcaactacgccgaccgcaagtggtgcttcgacggcatcaagaacaaccagatcctggaggagaacgtggaggtcgagatctggacgaaggagggcgagcggaagaagctcaagccgcgctggctggacgcccggatctactccgaccccctggcgctcaaggagttcaaggagttcgccgccgggcgcaagagcctgaccctgaacctcatcaccgagatgggccggctgcccaccttcatgacgcagaaggcccgcaacgccctggacaacctcgcggtgctgcacaccgccgaggtcgggggcaaggcctacacccacgccctgtccgagctccccgagaccctggagacgctgctcctgctgaccctcctggccgcggtcaccggcgggatcttcctgttcctcatgagcggcaagggggtgggcaagatgaccctggggatgtgctgcatcatcaccgcctccatcctgctctggtacgcccagatccagccgcactggatcgccgccagcatcatcctggagttcttcctgatcgtcctcctgatccccgagcccgagaagcagcggacgccccaggacaaccagctgacctacgtggtgatcgcgatcctcaccgtcgtggccgccaccatggccaacgagatgggcttcctggagaagacgaagaaggacctgggcttcgggtccatcaccacccaggagagcgagagcaacatcctcgacatcgacctgcgcccggcctccgcgtggaccctgtacgccgtggccacgaccttcgtcacccccatgctccggcacagcatcgagaactccagcgtgaacgtgtccctgaccgccatcgcgaaccaggccacggtcctgatgggcctcgggaagggctggcccctgagcaagatggacatcggggtgcccctgctcgccatcggctgctactcccaggtgaacccgatcaccctgaccgccgccctgctcctgctggtcgcgcactacgccatcatcggccccgggctccaggccaaggccacccgcgaggcccagaagcgggcggccgccggcatcatgaagaaccccacggtggacgggatcaccgtgatcgacctggagcccatcccgtacgaccccaagttcgagaagcagctgggccaggtcatgctcctgatcctgtgcgtgacccaggtgctcatgatgcgcaccacgtgggccctgtgcgaggccctgaccctcgcgaccgggcccatcagcaccctgtgggagggcaaccccggccggttctggaacacgaccatcgccgtctccatggccaacatcttccgcgggagctacctggccggcgcggggctcctgttctccatcatgaagaacaccaccaacacgcgccggggcaccggcaacgtgggggagaccctgggcgagaagtggaagtcccgcctcaacgccctggggaagtccgagttccagatctacaagaagtccggcatccaggaggtggaccggaccctggccaaggaggggatcaagcgcggcgagacggaccaccacgccgtctcccggggcagcgccaagctccgctggttcgtggagcggaacatggtgaccccggaggggaaggtcgtggacctgggctgcgggcgcggcgggtggtcctactactgcggcggcctgaagaacgtgcgggaggtcaaggggctcaccaagggcgggcccggccacgaggagcccatccccatgagcacctacgggtggaacctggtgcgcctgcagtccggcgtggacgtcttcttcacgccgcccgagaagtgcgacaccctcctgtgcgacatcggcgagagcagccccaaccccaccatcgaggcggggcggaccctgcgcgtgctcaacctggtggagaactggctgaacaacaacacccagttctgcatcaaggtcctcaacccgtacatgccctccgtgatcgagaagatggagacgctgcagcggaagtacggcggggccctggtgcgcaaccccctgagccggaactccacccacgagatgtactgggtcagcaacgccaccggcaacatcgtgtccagcgtgaacatgatctcccgcatgctcatcaaccggttcaccatgaagcacaagaaggccacgtacgagccggacgtcgacctggggagcggcacccgcaacatcggcatcgagtccgagatccccaacctggacatcgtggggaagcggatcgagaagatcaagcaggagcacgagaccagctggcactacgaccaggaccacccctacaagacctgggcctaccacggctcctacgagacgaagcagaccgggagcgcgtccagcatggtgaacggcgtcgtgcgcctcctgaccaagccctgggacgtggtcccgatggtgacccagatggccatgacggacaccacccccttcggccagcagcgcgtgttcaaggagaaggtcgacacccggacgcaggagcccaaggaggggaccaagaagctgatgaagatcaccgccgagtggctctggaaggagctgggcaaggagaagacgccccgcatgtgcacgcgggaggagttcacccgcaaggtgcggtccaacgccgccctgggggcggtgttcaccgacgagaacaagtggaagtccgcccgcgaggccgtcgaggacggccggttctgggagctcgtggaccgcgagcggaacctgcacctggaggggaagtgcgagacctgcgtctacaacatgatgggcaagcgcgagaagaagctcggcgagttcgggaaggccaagggctcccgggcgatctggtacatgtggctgggggcccgcttcctggagttcgaggccctcggcttcctgaacgaggaccactggttcagccgggggaactccctgagcggcgtggagggcgaggggctccaccgcctgggctacatcctgcgggaggtggggaagaaggagggcggggccatgtacgccgacgacacggcgggctgggacacccgcatcaccctcgaggacctgaagaacgaggagatggtcaccaaccacatgaagggcgagcacaagaagctggccgaggccatcttcaagctcacgtaccagaacaaggtggtgcgggtccagcgcccgacgccccgggggaccgtgatggacatcatcagccgcaaggaccagcggggctccggccaggtggggacctacggcctgaacacgttcaccaacatggaggcccagctgatccgccagatggagggggagggcatcttcaagagcatccagcacctcaccgccaccgaggagatcgcggtccagaactggctggcccgcgtggggcgggagcgcctgtcccggatggccatcagcggcgacgactgcgtggtcaagcccatcgacgaccgcttcgcctccgccctcacggcgctgaacgacatggggaaggtgcggaaggacatccagcagtgggagcccagccgcggctggaacgactggacccaggtgccgttctgctcccaccacttccacgagctggtcatgaaggacggccgggtgctcgtggtcccctgccgcaaccaggacgagctgatcgggcgggcccgcatcagccagggcgccgggtggtccctgaaggagaccgcctgcctcggcaagagctacgcccagatgtggaccctgatgtacttccaccggcgcgacctgcggctcgcggccaacgccatctgctccgccgtgcccagccactgggtgcccacctcccgcacgacctggagcatccacgcgaagcacgagtggatgaccaccgaggacatgctggtcgtgtggaaccgggtgtggatccaggagaacccgtggatggaggacaagacgcccgtcgagtcctgggaggaggtgccctacctggggaagcgcgaggaccagtggtgcggcagcctcatcggcctgacctcccgggccacctgggccaagaacatccagaccgccatcaaccaggtgcgcagcctgatcgggaacgagggctacacggactacatgcccagcatgaagcggttccgccgcgaggaggaggaggccggggtcctctggtga

SEQ ID NO: 9304 - RNA, 9876 nt, synthetic construct
  misc_feature 1..9876: note = derived and/or modified CDS sequence (opt1) from DENV-2__KC294208__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggagggggaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaacaacacccagttctgcatcaaggtgctgaacccgtacatgcccagcgtcatcgagaagatggagacgctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagagcgagatccccaacctggacatcgtcggcaagcggatcgagaagatcaagcaggagcacgagacctcctggcactacgaccaggaccacccctacaagacctgggcctaccacgggagctacgagacgaagcagaccggctccgcgagctccatggtgaacggggtggtccgcctgctcaccaagccctgggacgtggtgccgatggtcacccagatggccatgacggacaccacccccttcggccagcagcgcgtgttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtccggagcaacgccgccctgggcgcggtgttcaccgacgagaacaagtggaagtccgcccgcgaggccgtggaggacgggcggttctgggagctggtcgaccgcgagcggaacctccacctggagggcaagtgcgagacctgcgtgtacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtcgagggcgagggcctgcaccgcctcgggtacatcctgcgggaggtgggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtcgtgcgggtgcagcgcccgacgccccggggcaccgtcatggacatcatctcccgcaaggaccagcgggggagcggccaggtggggacctacggcctcaacacgttcaccaacatggaggcccagctgatccgccagatggagggcgaggggatcttcaagtccatccagcacctgaccgccaccgaggagatcgcggtgcagaactggctcgcccgcgtcggccgggagcgcctgagccggatggccatctccggggacgactgcgtggtgaagcccatcgacgaccgcttcgccagcgccctgacggcgctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtcccctcccactgggtgcccaccagccgcacgacctggtccatccacgcgaagcacgagtggatgaccaccgaggacatgctcgtggtctggaaccgggtgtggatccaggagaacccgtggatggaggacaagacgcccgtggagagctgggaggaggtcccctacctgggcaagcgcgaggaccagtggtgcgggtccctgatcggcctcaccagccgggccacctgggccaagaacatccagaccgccatcaaccaggtgcgcagcctgatcggcaacgaggggtacacggactacatgccctccatgaagcggttccgccgcgaggaggaggaggccggcgtgctgtggtga

SEQ ID NO: 9305 - RNA, 9876 nt, synthetic construct
  misc_feature 1..9876: note = derived and/or modified CDS sequence (opt1) from DENV-2__KC294209__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcgtggggaagatgaccctcggcatgtgctgcatcatcaccgccagcatcctgctgtggtacgcccagatccagccgcactggatcgccgcctccatcatcctcgagttcttcctgatcgtcctgctcatccccgagcccgagaagcagcggacgccccaggacaaccagctgacctacgtggtgatcgcgatcctgaccgtcgtggccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtcacccccatgctgcggcactccatcgagaacagctccgtgaacgtgagcctcaccgccatcgcgaaccaggccacggtcctgatggggctgggcaaggggtggcccctctccaagatggacatcggcgtgcccctgctggccatcgggtgctacagccaggtgaacccgatcaccctcaccgccgccctgctgctcctggtcgcgcactacgccatcatcggccccggcctgcaggccaaggccacccgcgaggcccagaagcgggcggccgccgggatcatgaagaaccccacggtggacggcatcaccgtgatcgacctcgagcccatcccgtacgaccccaagttcgagaagcagctggggcaggtcatgctgctcatcctgtgcgtgacccaggtgctgatgatgcgcaccacgtgggccctctgcgaggccctgaccctggcgaccggccccatctccaccctctgggaggggaaccccggccggttctggaacacgaccatcgccgtcagcatggccaacatcttccgcggctcctacctggccggggcgggcctcctgttcagcatcatgaagaacaccaccaacacgcgccgggggaccggcaacgtgggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtcagccggggctccgccaagctgcgctggttcgtggagcggaacatggtgaccccggagggcaaggtcgtggacctcgggtgcggccgcgggggctggagctactactgcgggggcctgaagaacgtgcgggaggtcaagggcctgaccaagggcggccccgggcacgaggagcccatccccatgtccacctacggctggaacctcgtgcgcctgcagagcggggtggacgtcttcttcacgccgcccgagaagtgcgacaccctgctctgcgacatcggcgagagctcccccaaccccaccatcgaggcgggccggaccctgcgcgtgctgaacctcgtggagaactggctgaacaacaacacccagttctgcatcaaggtcctgaacccgtacatgcccagcgtgatcgagaagatggagacgctccagcggaagtacgggggcgccctggtgcgcaaccccctgtcccggaacagcacccacgagatgtactgggtctccaacgccaccgggaacatcgtgagctccgtgaacatgatcagccgcatgctgatcaaccggttcaccatgaagcacaagaaggccacgtacgagccggacgtcgacctcggctccgggacccgcaacatcggcatcgagagcgagatccccaacctggacatcgtgggcaagcggatcgagaagatcaagcaggagcacgagacctcctggcactacgaccaggaccacccctacaagacctgggcctaccacgggagctacgagacgaagcagaccggctccgcgagctccatggtgaacggggtcgtgcgcctgctcaccaagccctgggacgtggtcccgatggtgacccagatggccatgacggacaccacccccttcggccagcagcgcgtgttcaaggagaaggtcgacacccggacgcaggagcccaaggagggcaccaagaagctgatgaagatcaccgccgagtggctgtggaaggagctcgggaaggagaagacgccccggatgtgcacgcgggaggagttcacccgcaaggtgcggagcaacgccgccctgggcgcggtgttcaccgacgagaacaagtggaagtccgcccgcgaggccgtcgaggacgggcggttctgggagctggtggaccgcgagcggaacctccacctggagggcaagtgcgagacctgcgtctacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtggagggcgagggcctgcaccgcctcgggtacatcctgcgggaggtgggcaagaaggagggcggcgccatgtacgccgacgacacggcggggtgggacacccgcatcaccctggaggacctcaagaacgaggagatggtcaccaaccacatgaagggcgagcacaagaagctggccgaggccatcttcaagctgacgtaccagaacaaggtggtgcgggtccagcgcccgacgccccggggcaccgtgatggacatcatctcccgcaaggaccagcgggggagcggccaggtggggacctacggcctcaacacgttcaccaacatggaggcccagctgatccgccagatggagggcgaggggatcttcaagtccatccagcacctgaccgccaccgaggagatcgcggtccagaactggctcgcccgcgtgggccgggagcgcctgagccggatggccatctccggggacgactgcgtggtcaagcccatcgacgaccgcttcgccagcgccctgacggcgctcaacgacatgggcaaggtgcggaaggacatccagcagtgggagccctcccgcgggtggaacgactggacccaggtgccgttctgcagccaccacttccacgagctggtcatgaaggacggccgggtgctggtggtcccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtgccctcccactgggtgcccaccagccgcacgacctggtccatccacgcgaagcacgagtggatgaccaccgaggacatgctcgtcgtgtggaaccgggtgtggatccaggagaacccgtggatggaggacaagacgcccgtcgagagctgggaggaggtgccctacctgggcaagcgcgaggaccagtggtgcgggtccctgatcggcctcaccagccgggccacctgggccaagaacatccagaccgccatcaaccaggtgcgcagcctgatcggcaacgaggggtacacggactacatgccctccatgaagcggttccgccgcgaggaggaggaggccggcgtcctgtggtga

SEQ ID NO: 9306 - RNA, 9876 nt, synthetic construct
  misc_feature 1..9876: note = derived and/or modified CDS sequence (opt1) from DENV-2__KC294214__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggcggaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccgcagcgtcacgcggctggagaacctcatgtggaagcagatcacccccgagctgaaccacatcctgtccgagaacgaggtgaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtggaggactacggcttcggggtcttcaccaccaacatctggctcaagctgcgggagaagcaggacgtgttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccggccgggctaccacacccagaccgcggggccctggcacctcggcaagctggagatggacttcgacttctgcgaggggaccacggtcgtggtgaccgaggactgcggcaaccgcggccccagcctgcggaccaccacggccagcgggaagctcatcaccgagtggtgctgccgctcctgcaccctgcccccgctgcggtaccgcggcgaggacgggtgctggtacggcatggagatccggcccctcaaggagaaggaggagaacctggtcaacagcctggtgaccgccgggcacggccagatcgacaacttctccctcggcgtgctggggatggccctgttcctcgaggagatgctgcgcacgcgggtcggcaccaagcacgcgatcctgctcgtggccctgagcttcgtgaccctgatcaccgggaacatgtccttccgcgacctcggccgcgtcatggtgatggtgggggccacgatgaccgacgacatcggcatgggcgtcacctacctggccctgctcgccgcgttcaaggtgcggcccaccttcgccgccgggctgctgctccgcaagctgacgagcaaggagctgatgatggccaccatcggcatcgccctcctgtcccagagcaccctgcccgagaccatcctcgagctgacggacgcgctggccctcgggatgatggccctgaagatcgtgcggaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccgcacgagcaagaagcggtcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccgcagcgccgacctcgagctggagcgggccgccgacgtcaagtgggaggaccaggcggagatctccgggagctcccccatcctgagcatcacgatctccgaggacggcagcatgtccatcaagaacgaggaggaggagcagaccctcaccatcctgatccgcaccggcctgctcgtgatcagcggggtgttcccggtctccatccccatcaccgccgccgcctggtacctgtgggaggtgaagaagcagcgggccggcgtgctgtgggacgtccccagcccgccgcccgtggggaaggcggagctcgaggacggcgcctaccgcatcaagcagcgggggatcctgggctactcccagatcggcgccggggtgtacaaggagggcacgttccacaccatgtggcacgtcacccgcggggccgtgctgatgcaccggggcaagcgcatcgagcccagctgggccgacgtgaagaaggacctcatctcctacgggggcggctggaagctggagggggagtggaaggagggcgaggaggtccaggtgctggcgctcgagcccgggaagaacccccgggccgtgcagaccaagcccggcatcttcaagacgaacaccgggaccatcggcgccgtcagcctggacttctcccccggcaccagcgggtcccccatcgtggaccgcaagggcaaggtggtcgggctgtacggcaacggcgtggtgacgcggagcggggcctacgtctccgcgatcgcccagaccgagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcgcacgctcatcctggcgccgacccgggtggtcgccgccgagatggaggaggccctgcgcgggctccccatccggtaccagacccccgccatccgcgcggagcacaccggccgggagatcgtggacctgatgtgccacgccacgttcaccatgcgcctgctcagccccgtgcgggtcccgaactacaacctgatcatcatggacgaggcccacttcaccgaccccgcctccatcgccgcgcgcggctacatcagcacccgggtggagatgggggaggccgccggcatcttcatgacggccacgccgcccgggtcccgcgacccgttcccccagagcaacgcgcccatcatggacgaggagcgggagatccccgagcgctcctggaacagcggccacgagtgggtgaccgacttcaaggggaagaccgtctggttcgtgccgtccatcaaggccggcaacgacatcgccgcctgcctgcggaagaacggcaagaaggtgatccagctcagccgcaagacgttcgactccgagtacgtcaagacccgggccaacgactgggacttcgtggtgaccaccgacatcagcgagatgggggcgaacttcaaggccgagcgcgtcatcgacccccggcgctgcatgaagcccgtgatcctgacggacggcgaggagcgggtgatcctggccgggcccatgccggtcacccactccagcgccgcccagcgccgcggccggatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgggagaaggtggacgccatcgacggggagtaccgcctccggggcgaggcccgcaagaccttcgtggacctgatgcggcgcggggacctgcccgtctggctcgcctacaaggtggcggccgagggcatcaactacgccgaccggaagtggtgcttcgacgggatcaagaacaaccagatcctggaggagaacgtggaggtcgagatctggacgaaggagggcgagcgcaagaagctgaagccgcggtggctcgacgcccgcatctacagcgaccccctggcgctgaaggagttcaaggagttcgccgccggccggaagtccctcaccctgaacctgatcaccgagatggggcgcctccccaccttcatgacgcagaaggcccggaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcgcacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccggccggccagcgcgtggaccctgtacgccgtggccacgaccttcgtgacccccatgctgcgccactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgggaggcccagaagcgcgcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcggaccacgtgggccctctgcgaggccctgaccctggcgaccggccccatctccaccctctgggaggggaaccccggccgcttctggaacacgaccatcgccgtgagcatggccaacatcttccgcggctcctacctggccggggcgggcctcctgttcagcatcatgaagaacaccaccaacacgcggcgcgggaccggcaacgtcggcgagaccctgggggagaagtggaagtcccggctgaacgccctcggcaagagcgagttccagatctacaagaagtccgggatccaggaggtggaccgcaccctggccaaggagggcatcaagcgcggggagacggaccaccacgccgtgagccgcggctccgccaagctgcggtggttcgtcgagcgcaacatggtgaccccggagggcaaggtggtcgacctcgggtgcggccgcgggggctggagctactactgcgggggcctgaagaacgtgcgcgaggtgaagggcctgaccaagggcggccccgggcacgaggagcccatccccatgtccacctacggctggaacctcgtccggctgcagagcggggtggacgtgttcttcacgccgcccgagaagtgcgacaccctgctctgcgacatcggcgagagctcccccaaccccaccatcgaggcgggccgcaccctgcgggtcctgaacctcgtggagaactggctgaacaacaacacccagttctgcatcaaggtgctgaacccgtacatgcccagcgtcatcgagaagatggagacgctccagcgcaagtacgggggcgccctggtgcggaaccccctgtcccgcaacagcacccacgagatgtactgggtgtccaacgccaccgggaacatcgtcagctccgtgaacatgatcagccggatgctgatcaaccgcttcaccatgaagcacaagaaggccacgtacgagccggacgtggacctcggctccgggacccggaacatcggcatcgagagcgagatccccaacctggacatcgtcggcaagcgcatcgagaagatcaagcaggagcacgagacctcctggcactacgaccaggaccacccctacaagacctgggcctaccacgggagctacgagacgaagcagaccggctccgcgagctccatggtgaacggggtggtccgcctgctcaccaagccctgggacgtggtgccgatggtcacccagatggccatgacggacaccacccccttcggccagcagcgggtgttcaaggagaaggtggacacccgcacgcaggagcccaaggagggcaccaagaagctgatgaagatcaccgccgagtggctgtggaaggagctcgggaaggagaagacgccccggatgtgcacgcgcgaggagttcacccggaaggtccgcagcaacgccgccctgggcgcggtgttcaccgacgagaacaagtggaagtccgcccgggaggccgtggaggacgggcgcttctgggagctggtcgaccgggagcgcaacctccacctggagggcaagtgcgagacctgcgtgtacaacatgatggggaagcgggagaagaagctgggcgagttcggcaaggccaaggggagccgcgcgatctggtacatgtggctcggcgcccggttcctggagttcgaggccctggggttcctcaacgaggaccactggttctcccgcggcaacagcctgagcggggtcgagggcgagggcctgcaccggctcgggtacatcctgcgcgaggtgggcaagaaggagggcggcgccatgtacgccgacgacacggcggggtgggacacccggatcaccctggaggacctcaagaacgaggagatggtgaccaaccacatgaagggcgagcacaagaagctggccgaggccatcttcaagctgacgtaccagaacaaggtcgtgcgcgtgcagcggccgacgccccgcggcaccgtcatggacatcatctcccggaaggaccagcgcgggagcggccaggtggggacctacggcctcaacacgttcaccaacatggaggcccagctgatccgccagatggagggcgaggggatcttcaagtccatccagcacctgaccaccacggaggagatcgccgtgcagaactggctcgcgcgggtcggccgcgagcggctgagccgcatggccatctccggggacgactgcgtggtgaagcccatcgacgaccggttcgccagcgccctgaccgccctcaacgacatgggcaaggtccgcaaggacatccagcagtgggagccctcccgggggtggaacgactggacccaggtgccgttctgcagccaccacttccacgagctggtgatgaaggacggccgcgtcctggtggtgccctgccggaaccaggacgagctcatcggccgcgcgcggatctcccagggggccggctggagcctgaaggagaccgcctgcctggggaagtcctacgcccagatgtggaccctcatgtacttccaccgccgggacctgcgcctggccgcgaacgccatctgcagcgccgtcccctcccactgggtgcccacgagccggaccacctggtccatccacgccaagcacgagtggatgaccacggaggacatgctcgtggtctggaaccgcgtgtggatccaggagaacccgtggatggaggacaagacccccgtggagagctgggaggaggtcccctacctgggcaagcgggaggaccagtggtgcgggtccctgatcggcctcaccagccgcgcgacctgggccaagaacatccagacggccatcaaccaggtgcggagcctgatcggcaacgaggggtacaccgactacatgccctccatgaagcgcttccgccgggaggaggaggaggccggcgtgctgtggtga

SEQ ID NO: 9307 - RNA, 9876 nt, synthetic construct
  misc_feature 1..9876: note = derived and/or modified CDS sequence (opt1) from DENV-2__KC294205__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccaccagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaccaacacgcagttctgcatcaaggtgctgaacccgtacatgcccagcgtcatcgagaagatggagaccctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcacgatgaagcacaagaaggccacctacgagccggacgtggacctcggctccgggacccgcaacatcggcatcgagagcgagatccccaacctggacatcgtcggcaagcggatcgagaagatcaagcaggagcacgagacctcctggcactacgaccaggaccacccctacaagacgtgggcctaccacgggagctacgagaccaagcagaccggctccgcgagctccatggtgaacggggtggtccgcctgctcaccaagccctgggacgtggtgccgatggtcacgcagatggccatgaccgacaccacccccttcggccagcagcgcgtgttcaaggagaaggtggacacgcggacccaggagcccaaggagggcaccaagaagctgatgaagatcaccgccgagtggctgtggaaggagctcgggaaggagaagacgccccgcatgtgcacccgggaggagttcacccgcaaggtccggagcaacgccgccctgggcgcggtgttcaccgacgagaacaagtggaagtccgcccgcgaggccgtggaggacgggcggttctgggagctggtcgaccgcgagcggaacctccacctggagggcaagtgcgagacgtgcgtgtacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtcgagggcgagggcctgcaccgcctcgggtacatcctgcgggaggtgggcaagaaggagggcggcgccatgtacgccgacgacaccgcggggtgggacacccgcatcaccctggaggacctcaagaacgaggagatggtgacgaaccacatgaagggcgagcacaagaagctggccgaggccatcttcaagctgacctaccagaacaaggtcgtgcgggtgcagcgcccgacgccccggggcaccgtcatggacatcatctcccgcaaggaccagcgggggagcggccaggtggggacgtacggcctcaacaccttcaccaacatggaggcccagctgatccgccagatggagggcgaggggatcttcaagtccatccagcacctgaccgccacggaggagatcgcggtgcagaactggctcgcccgcgtcggccgggagcgcctgagccggatggccatctccggggacgactgcgtggtgaagcccatcgacgaccgcttcgccagcgccctgaccgcgctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtcccctcccactgggtgcccacgagccgcaccacctggtccatccacgcgaagcacgagtggatgaccacggaggacatgctcgtggtctggaaccgggtgtggatccaggagaacccgtggatggaggacaagacccccgtggagagctgggaggaggtcccctacctgggcaagcgcgaggaccagtggtgcgggtccctgatcggcctcaccagccgggccacctgggccaagaacatccagacggccatcaaccaggtgcgcagcctgatcggcaacgaggggtacaccgactacatgccctccatgaagcggttccgccgcgaggaggaggaggccggcgtgctgtggtga

SEQ ID NO: 9308 - RNA, 9876 nt, synthetic construct
  misc_feature 1..9876: note = derived and/or modified CDS sequence (opt1) from DENV-2__KC294210__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgatgatggagtccagcccccgcaccggcctcgacttcaacgagatggtgctgctgcagatggaggacaaggcctggctcgtccaccggcagtggttcctggacctgcccctcccctggctgccgggggccgacacccagggctccaactggatccagaaggagacgctggtgaccttcaagaacccccacgcgaagaagcaggacgtggtcgtgctcgggagccaggagggcgccatgcacaccgccctgaccggggccacggagatccagatgagctccggcaacctcctgttcaccggccacctgaagtgccgcctgcggatggacaagctccagctgaaggggatgagctactccatgtgcaccggcaagttcaagatcgtcaaggagatcgccgagacccagcacgggacgatcgtgatccgcgtgcagtacgagggcgacggcagcccctgcaagatccccttcgagatcaccgacctggagaagcggcacgtcctcgggcgcctgatcaccgtgaacccgatcgtgaccgagaaggactcccccgtcaacatcgaggcggagccgcccttcggcgacagctacatcatcgtgggggtggagccgggccagctgaagctcaactggttcaagaaggggtccagcatcggccagatgttcgagacgaccatgcgcggcgccaagcggatggccatcctgggggacaccgcctgggacttcggctccctcggcggggtcttcaccagcatcgggaaggccctccaccaggtgttcggggcgatctacggcgccgccttctccggggtgagctggacgatgaagatcctgatcggcgtcatcatcacctggatcgggatgaactcccgcagcacctccctgagcgtgtccctggtgctcgtcggcgtggtgaccctgtacctgggggccatggtccaggcggacagcggctgcatcgtgtcctggaagaacaaggagctcaagtgcggcagcgggatcttcatcacggacaacgtgcacacctggaccgagcagtacaagttccagcccgagagcccctccaagctggccagcgccatccagaaggcccacgaggagggcatctgcgggatccggtccgtcacccgcctggagaacctcatgtggaagcagatcacgcccgagctgaaccacatcctgagcgagaacgaggtgaagctcaccatcatgaccggcgacatcaaggggatcatgcaggccggcaagcggtccctgcgcccgcagcccaccgagctgaagtacagctggaagacgtggggcaaggcgaagatgctctccaccgagagccacaaccagaccttcctgatcgacgggcccgagaccgccgagtgcccgaacacgaaccgggcctggaactccctggaggtggaggactacggcttcggggtcttcaccaccaacatctggctcaagctgcgcgagaagcaggacgtgttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgcctccgggaagctcatcacggagtggtgctgccggagctgcaccctgcccccgctgcgctaccggggcgaggacgggtgctggtacggcatggagatccgccccctcaaggagaaggaggagaacctggtcaactccctggtgaccgccgggcacggccagatcgacaacttcagcctcggcgtgctggggatggccctgttcctcgaggagatgctgcggacccgcgtcggcacgaagcacgcgatcctgctcgtggccctgtccttcgtgaccctgatcaccgggaacatgagcttccgggacctcggccgcgtcatggtgatggtgggggccaccatgacggacgacatcggcatgggcgtcacctacctggccctgctcgccgcgttcaaggtgcgccccaccttcgccgccgggctgctgctccggaagctgacctccaaggagctgatgatggccacgatcggcatcgccctcctgagccagtccaccctgcccgagaccatcctcgagctgaccgacgcgctggccctcgggatgatggccctgaagatcgtgcgcaacatggagaagtaccagctggccgtcacgatcatggccatcagctgcgtgccgaacgcggtgatcctccagaacgcctggaaggtctcctgcaccatcctggccgccgtgagcgtgagccccctgctcctgaccagctcccagcagaaggcggactggatccccctggccctcaccatcaagggcctgaaccccacggccatcttcctgaccaccctcagccggacctccaagaagcgcagctggccgctgaacgaggccatcatggccgtcggcatggtgtccatcctggcgagcagcctcctgaagaacgacatccccatgacggggcccctggtcgccggcgggctcctgaccgtgtgctacgtgctgaccggccggtccgccgacctcgagctggagcgcgccgccgacgtcaagtgggaggaccaggcggagatcagcgggtccagccccatcctgtccatcaccatcagcgaggacggctccatgagcatcaagaacgaggaggaggagcagacgctcaccatcctgatccggaccggcctgctcgtgatctccggggtgttcccggtcagcatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctacagccagatcggcgccggggtgtacaaggagggcaccttccacacgatgtggcacgtcacccgcggggccgtgctgatgcaccgcggcaagcggatcgagccctcctgggccgacgtgaagaaggacctcatcagctacgggggcggctggaagctggagggggagtggaaggagggcgaggaggtccaggtgctggcgctcgagcccgggaagaacccccgcgccgtgcagaccaagcccggcatcttcaagaccaacacggggaccatcggcgccgtctccctggacttcagccccggcacctccgggagccccatcgtggaccggaagggcaaggtggtcgggctgtacggcaacggcgtggtgacccgctccggggcctacgtcagcgcgatcgcccagacggagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcaccctcatcctggcgccgacgcgcgtggtcgccgccgagatggaggaggccctgcgggggctccccatccgctaccagacccccgccatccgggcggagcacaccggccgcgagatcgtggacctgatgtgccacgccaccttcacgatgcggctgctctcccccgtgcgcgtcccgaactacaacctgatcatcatggacgaggcccacttcaccgaccccgccagcatcgccgcgcggggctacatctccacccgcgtggagatgggggaggccgccggcatcttcatgaccgccacgccgcccgggagccgggacccgttcccccagtccaacgcgcccatcatggacgaggagcgcgagatccccgagcggagctggaactccggccacgagtgggtgaccgacttcaaggggaagaccgtctggttcgtgccgagcatcaaggccggcaacgacatcgccgcctgcctgcgcaagaacggcaagaaggtgatccagctctcccggaagaccttcgacagcgagtacgtcaagacgcgcgccaacgactgggacttcgtggtgaccaccgacatctccgagatgggggcgaacttcaaggccgagcgggtcatcgacccccgccggtgcatgaagcccgtgatcctgaccgacggcgaggagcgcgtgatcctggccgggcccatgccggtcacgcacagctccgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggaccaaggagggcgagcggaagaagctgaagccgcgctggctcgacgcccggatctactccgaccccctggcgctgaaggagttcaaggagttcgccgccggccgcaagagcctcacgctgaacctgatcaccgagatggggcggctccccaccttcatgacccagaaggcccgcaacgccctggacaacctggcggtgctccacacggccgaggtgggcgggaaggcctacacccacgccctgtccgagctgcccgagaccctcgagaccctgctgctcctgacgctgctcgccgcggtcaccggcggcatcttcctgttcctgatgagcgggaagggcatcgggaagatgaccctcggcatgtgctgcatcatcaccgcctccatcctgctgtggtacgcccagatccagccgcactggatcgccgccagcatcatcctcgagttcttcctgatcgtgctgctcatccccgagcccgagaagcagcggacgccccaggacaaccagctgacgtacgtcgtgatcgcgatcctgaccgtggtcgccgccaccatggccaacgagatggggttcctcgagaagaccaagaaggacctgggcttcggcagcatcacgacccaggagtccgagagcaacatcctggacatcgacctccgcccggcctccgcgtggaccctgtacgccgtggccaccacgttcgtgacccccatgctgcggcacagcatcgagaactccagcgtcaacgtgtccctcaccgccatcgcgaaccaggccaccgtgctgatggggctgggcaaggggtggcccctcagcaagatggacatcggcgtccccctgctggccatcgggtgctactcccaggtgaacccgatcacgctcaccgccgccctgctgctcctggtggcgcactacgccatcatcggccccggcctgcaggccaaggccacccgcgaggcccagaagcgggcggccgccgggatcatgaagaaccccaccgtcgacggcatcacggtgatcgacctcgagcccatcccgtacgaccccaagttcgagaagcagctggggcaggtcatgctgctcatcctgtgcgtcacccaggtgctgatgatgcgcaccacctgggccctctgcgaggccctgacgctggcgaccggccccatcagcaccctctgggaggggaaccccggccggttctggaacaccacgatcgccgtgtccatggccaacatcttccgcggcagctacctggccggggcgggcctcctgttctccatcatgaagaacaccaccaacacccgccgggggacgggcaacgtcggcgagaccctgggggagaagtggaagtcccgcctgaacgccctcggcaagtccgagttccagatctacaagaagtccgggatccaggaggtggaccggaccctggccaaggagggcatcaagcgcggggagaccgaccaccacgccgtgtcccggggcagcgccaagctgcgctggttcgtcgagcggaacatggtgacgccggagggcaaggtggtcgacctcgggtgcggccgcgggggctggtcctactactgcgggggcctgaagaacgtgcgggaggtgaagggcctgaccaagggcgggcccgggcacgaggagcccatccccatgagcacctacggctggaacctcgtccgcctgcagagcggggtggacgtgttcttcaccccgcccgagaagtgcgacacgctgctctgcgacatcggcgagtccagccccaaccccaccatcgaggcgggccggaccctgcgcgtcctgaacctcgtggagaactggctgaacaacaacacccagttctgcatcaaggtgctgaacccgtacatgccctccgtcatcgagaagatggagaccctccagcggaagtacgggggcgccctggtgcgcaaccccctgagccggaactccacgcacgagatgtactgggtgagcaacgccaccgggaacatcgtctccagcgtgaacatgatctcccgcatgctgatcaaccggttcaccatgaagcacaagaaggccacctacgagccggacgtggacctcggcagcgggacgcgcaacatcggcatcgagtccgagatccccaacctggacatcgtcggcaagcggatcgagaagatcaagcaggagcacgagaccagctggcactacgaccaggaccacccctacaagacctgggcctaccacgggtcctacgagaccaagcagacgggcagcgcgtccagcatggtgaacggggtggtccgcctgctcaccaagccctgggacgtggtgccgatggtcacccagatggccatgaccgacacgacccccttcggccagcagcgcgtgttcaaggagaaggtggacacccggacccaggagcccaaggagggcacgaagaagctgatgaagatcaccgccgagtggctgtggaaggagctcgggaaggagaagacgccccggatgtgcacccgggaggagttcacgcgcaaggtccggtccaacgccgccctgggcgcggtgttcaccgacgagaacaagtggaagtccgcccgcgaggccgtggaggacgggcggttctgggagctggtcgaccgcgagcggaacctccacctggagggcaagtgcgagacctgcgtgtacaacatgatggggaagcgcgagaagaagctgggcgagttcggcaaggccaaggggtcccgggcgatctggtacatgtggctcggcgcccgcttcctggagttcgaggccctggggttcctcaacgaggaccactggttcagccggggcaacagcctgtccggggtcgagggcgagggcctgcaccgcctcgggtacatcctgcgggaggtgggcaagaaggagggcggcgccatgtacgccgacgacaccgcggggtgggacacgcgcatcaccctggaggacctcaagaacgaggagatggtgaccaaccacatgaagggcgagcacaagaagctggccgaggccatcttcaagctgacctaccagaacaaggtcgtgcgggtgcagcgcccgacgccccggggcaccgtcatggacatcatcagccgcaaggaccagcgggggtccggccaggtggggacctacggcctcaacaccttcacgaacatggaggcccagctgatccgccagatggagggcgaggggatcttcaagagcatccagcacctgaccgccaccgaggagatcgcggtgcagaactggctcgtccgcgtgggccgggagcgcctgtcccggatggccatcagcggggacgactgcgtggtcaagcccatcgacgaccgcttcgcctccgccctgaccgccctcaacgacatgggcaaggtgcggaaggacatccagcagtgggagcccagccgcgggtggaacgactggacccaggtgccgttctgctcccaccacttccacgagctggtcatgaaggacggccgggtgctggtggtcccctgccgcaaccaggacgagctcatcggccgggcgcgcatcagccagggggccggctggtccctgaaggagaccgcctgcctgggcaagagctacgcccagatgtggaccctcatgtacttccaccggcgcgacctgcggctggccgcgaacgccatctgctccgccgtgcccagccactgggtgcccacctcccgcaccacgtggagcatccacgccaagcacgagtggatgaccaccgaggacatgctcgtcgtgtggaaccgggtgtggatccaggagaacccgtggatggaggacaagacccccgtcgagtcctgggaggaggtgccctacctgggcaagcgcgaggaccagtggtgcgggagcctgatcggcctcacgagccgggcgacctgggccaagaacatccagaccgccatcaaccaggtgcgctccctgatcggcaacgaggggtacaccgactacatgcccagcatgaagcggttccgccgcgaggaggaggaggccggcgtcctgtggtga

SEQ ID NO: 9309 - RNA, 9876 nt, synthetic construct
  misc_feature 1..9876: note = derived and/or modified CDS sequence (opt1) from DENV-2__KC294215__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaacaacacccagttctgcatcaaggtgctgaacccgtacatgcccagcgtcatcgagaagatggagacgctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagagcgagatccccaacctggacatcgtcggcaagcggatcgagaagatcaagcaggagcacgagacctcctggcactacgaccaggaccacccctacaagacctgggcctaccacgggagctacgagacgaagcagaccggctccgcgagctccatggtgaacggggtggtccgcctgctcaccaagccctgggacgtggtgccgatggtcacccagatggccatgacggacaccacccccttcggccagcagcgcgtgttcaaggagaaggtggacacccggacgcaggagcccaaggagggcaccaagaagctgatgaagatcaccgccaagtggctgtggaaggagctcgggaaggagaagacgccccggatgtgcacgcgggaggagttcacccgcaaggtccggagcaacgccgccctgggcgcggtgttcaccgacgagaacaagtggaagtccgcccgcgaggccgtggaggacgggcggttctgggagctggtcgaccgcgagcggaacctccacctggagggcaagtgcgagacctgcgtgtacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtcgagggcgagggcctgcaccgcctcgggtacatcctgcgggaggtgggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtcgtgcgggtgcagcgcccgacgccccggggcaccgtcatggacatcatctcccgcaaggaccagcgggggagcggccaggtggggacctacggcctcaacacgttcaccaacatggaggcccagctgatccgccagatggagggcgaggggatcttcaagtccatccagcacctgaccgccaccgaggagatcgcggtgcagaactggctcgcccgcgtcggccgggagcgcctgagccggatggccatctccggggacgactgcgtggtgaagcccatcgacgaccgcttcgccagcgccctgacggcgctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtcccctcccactgggtgcccaccagccgcacgacctggtccatccacgcgaagcacgagtggatgaccaccgaggacatgctcgtggtctggaaccgggtgtggatccaggagaacccgtggatggaggacaagacgcccgtggagagctgggaggaggtcccctacctgggcaagcgcgaggaccagtggtgcgggtccctgatcggcctcaccagccgggccacctgggccaagaacatccagaccgccatcaaccaggtgcgcagcctgatcggcaacgaggggtacacggactacatgccctccatgaagcggttccgccgcgaggaggaggaggccggcgtgctgtggtga

SEQ ID NO: 9310 - RNA, 9876 nt, synthetic construct
  misc_feature 1..9876: note = derived and/or modified CDS sequence (opt1) from DENV-2__KC294216__SS-prME
  source 1..9876: mol_type = other RNA
accgccggcgtgatcatcatgctgatccccaccgccatggcgttccacctcaccacccgcaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcgccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacctggagctcatcaagaccgaggccaagcagcccgccaccctgcgcaagtactgcatcgaggcgaagctgaccaacacgaccaccgagtcccggtgcccgacccagggcgagcccagcctcaacgaggagcaggacaagcgcttcatctgcaagcactccatggtggaccggggctgggggaacggctgcgggctgttcggcaagggcgggatcgtgacgtgcgccatgttcacgtgcaagaagaacatggagggcaaggtcgtgctgcccgagaacctcgagtacaccatcgtgatcacgccccacagcggggaggagcacgccgtcggcaacgacacggggaagcacggcgaggagatcaagatcaccccgcagtccagcatcaccgaggccgagctgaccgggtacggcaccgtgacgatggagtgcagcccccgcaccggcctggacttcaacgagatggtgctcctgcagatggaggagaaggcctggctggtccaccggcagtggttcctcgacctgcccctgccctggctcccgggggcggacacccagggcagcaactggatccagaaggagaccctggtgacgttcaagaacccccacgccaagaagcaggacgtggtcgtgctggggtcccaggagggcgccatgcacaccgccctcaccggggccaccgagatccagatgagcagcggcaacctgctgttcacgggccacctcaagtgccgcctgcggatggacaagctgcagctcaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctggagaagcggcacgtcctggggcgcctcatcacggtgaacccgatcgtgaccgagaaggacagccccgtcaacatcgaggccgagccgcccttcggcgactcctacatcatcatcggggtggagccgggccagctgaagctgaactggttcaagaaggggagctccatcggccagatgttcgagaccaccatgcgcggcgccaagcggatggccatcctcggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctctccgtcagcctggtgctggtgggcgtcgtgaccctctacctgggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctcgcctccgccatccagaaggcccacgaggagggcatctgcgggatccggagcgtcacccgcctggagaacctgatgtggaagcagatcacccccgagctcaaccacatcctgtccgagaacgaggtgaagctgaccatcatgacgggcgacatcaaggggatcatgcaggcgggcaagcggagcctccgcccgcagcccaccgagctgaagtactcctggaagacctggggcaaggccaagatgctgagcaccgagtcccacaaccagacgttcctcatcgacgggcccgagaccgccgagtgcccgaacaccaaccgggcctggaacagcctggaggtggaggactacggcttcggggtcttcaccacgaacatctggctgaagctccgcgagaagcaggacgtgttctgcgactccaagctgatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctctggtccaacggcgtgctggagagcgagatgatcatccccaagaacttcgcggggcccgtgtcccagcacaactaccgcccgggctaccacacccagaccgccgggccctggcacctgggcaagctcgagatggacttcgacttctgcgaggggacgaccgtcgtggtgaccgaggactgcggcaaccggggccccagcctgcgcaccacgaccgccagcgggaagctgatcaccgagtggtgctgccggtcctgcaccctgccgcccctgcgctaccggggcgaggacgggtgctggtacggcatggagatccgccccctgaaggagaaggaggagaacctcgtcaacagcctggtgacggccgggcacggccagatcgacaacttctccctgggcgtgctcgggatggcgctgttcctggaggagatgctccggacccgcgtcggcaccaagcacgccatcctgctggtggccgtgagcttcctcaccctgatcacggggaacatgtccttccgggacctgggccgcgtcatggtgatggtgggggtcgccatgaccgacgacatcggcatgggcgtgacctacctcgccctgctggcggccttcaaggtgcgccccaccttcgccgccgggctcctgctgcggaagctcacgagcaaggagctgatgatggccaccatcggcatcaccctgctctcccagagcaccacgcccgagaccatcctggagctgaccgacgcgctcgccctggggatgatggtcctgaagatcgtgcgcaacatggagaagtaccagctcgccgtgaccatcatgacgatctcctgcgtccccaacgccatgatcctgatcaacgcctggaaggtgagctgcaccatcctggcggtggtctccgtgagccccctcctgctgacctccagccagcagaagaccgactggatccccctcgccctgacgatcaagggcctgaaccccaccgccatcttcctcaccaccctgtcccggacgagcaagaagcgctcctggccgctgaacgaggccgtcatggcggtgggcatggtgagcatcctcgcctccagcctgctgaagaacgacatccccatgaccgggcccctcgtcgccggcgggctgctgaccgtgtgctacgtgctcaccggccggagcgccgacctggagctggagcgcgccgcggacgtcaagtgggaggaccaggccgagatctccgggagctcccccatcctcagcatcacgatctccgaggacggcagcatgtccatcaagaacgaggaggaggagcagaccctgaccatcctgatccggaccggcctcctggtgatcagcggggtgttcccggtctccatccccatcaccgccgccgcctggtacctgtgggaggtgcgcaagcagcgggcgggcgtgctctgggacgtcccctccccgccgcccgtggagaaggccgagctggaggacggggcctaccgcatcaagcagcggggcatcctggggtactcccagatcggcgccggcgtgtacaaggaggggacgttccacaccatgtggcacgtcacccgcggcgccgtgctcatgcaccgggggaagcgcatcgagcccagctgggcggacgtgaagaaggacctgatctcctacggcgggggctggaagctggagggcgagtggaaggagggggaggaggtccaggtgctcgccctggagcccggcaagaacccccgggccgtgcagaccaagcccgggctgttcaagacgaacaccggcaccatcggggccgtcagcctcgacttctcccccggcaccagcggctcccccatcgtggaccgcaaggggaaggtggtcggcctgtacgggaacggcgtggtgacgcggagcggcgcctacgtctccgcgatcgcccagaccgagaagtccatcgaggacaaccccgagatcgaggacgacatcttccgcaagaagcggctgaccatcatggacctgcaccccggggccggcaagaccaagcgctacctccccgccatcgtgcgggaggcgatcaagcgcgggctgcgcacgctgatcctcgccccgacccgggtggtcgccgccgagatggaggaggccctgcgcggcctgcccatccggtaccagacccccgcgatccgcgccgagcacaccgggcgggagatcgtggacctcatgtgccacgccacgttcaccatgcgcctgctgagccccgtgcgggtcccgaactacaacctcatcatcatggacgaggcccacttcaccgaccccgcctccatcgcggcccgcggctacatcagcacccgggtggagatgggcgaggccgccgggatcttcatgacggccacgccgcccggctcccgcgacccgttcccccagagcaacgcgcccatcatggacgaggagcgggagatccccgagcgctcctggaacagcgggcacgagtgggtgaccgacttcaagggcaagaccgtctggttcgtgccgtccatcaaggccgggaacgacatcgccgcctgcctgcggaagaacggcaagaaggtgatccagctgagccgcaagacgttcgactccgagtacgtcaagacccgggcgaacgactgggacttcgtggtgaccaccgacatcagcgagatgggcgccaacttccgcgccgagcgggtcatcgacccccgccggtgcatgaagcccgtgatcctcacggacggggaggagcgcgtgatcctggccggccccatgccggtcacccactccagcgccgcgcagcgccgggggcgcgtgggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtggacgccatcgacggcgagtaccggctgcgcggggaggcccggaagaccttcgtcgacctcatgcgccggggcgacctgcccgtgtggctggcgtaccgcgtggccgccgaggggatcaactacgccgaccggcgctggtgcttcgacggcatcaagaacaaccagatcctcgaggagaacgtcgaggtggagatctggacgaaggagggggagcggaagaagctgaagccgcgctggctggacgcccggatctacagcgaccccctcgcgctgaaggagttcaaggagttcgccgccggccgcaagtccctgaccctcaacctgatcaccgagatgggccggctgcccaccttcatgacgcagaaggcccgcaacgcgctcgacaacctggccgtcctgcacaccgccgaggccgggggccgggcctacaaccacgcgctcagcgagctgcccgagaccctggagaccctcctgctgctcacgctgctggccaccgtgaccgggggcatcttcctcttcctgatgtccggcaaggggatcggcaagatgaccctggggatgtgctgcatcatcaccgccagcatcctcctgtggtacgcccagatccagccgcactggatcgccgcgtccatcatcctggagttcttcctcatcgtgctgctgatccccgagcccgagaagcagcgcacgccccaggacaaccagctcacctacgtcgtgatcgccatcctgaccgtggtcgccgccaccatggccaacgagatgggcttcctggagaagacgaagcgggacctcgggctgggcagcatcaccacccaggagagcgagtccaacatcctggacatcgacctccgcccggcgagcgcctggaccctgtacgccgtggccacgaccttcgtgacccccatgctgcgccactccatcgagaacagctccgtcaacgtgagcctcaccgccatcgcgaaccaggccacggtgctgatgggcctggggaagggctggcccctctccaagatggacatcggggtccccctgctggccatcggctgctacagccaggtgaacccgatcaccctcaccgccgcgctgctgctcctggtggcccactacgccatcatcgggcccggcctgcaggccaaggccacccgggaggcgcagaagcgcgccgccgccggcatcatgaagaaccccacggtcgacgggatcaccgtgatcgacctcgagcccatcccgtacgaccccaagttcgagaagcagctgggccaggtgatgctgctcatcctgtgcgtcacccaggtgctgatgatgcggaccacgtgggccctctgcgaggcgctgaccctggccaccgggcccatctccaccctctgggagggcaaccccgggcgcttctggaacacgaccatcgccgtgagcatggccaacatcttccggggctcctacctggccggcgcggggctcctgttcagcatcatgaagaacaccaccaacacgcgccggggcaccgggaacatcggcgagaccctgggcgagaagtggaagtcccgcctgaacgccctcggcaagagcgagttccagatctacaagcggtccggcatccaggaggtcgaccgcaccctggccaaggaggggatcaagcggggcgagacggaccaccacgccgtgagccgcgggtccgcgaagctgcggtggttcgtggagcgcaacatggtcaccccggagggcaaggtggtggacctcggctgcgggcggggcgggtggagctactactgcggcgggctgaagaacgtccgcgaggtgaagggcctgaccaagggcgggcccggccacgaggagcccatccccatgtccacctacgggtggaacctcgtgcggctgcagagcggcgtcgacgtgttcttcacgccgcccgagaagtgcgacaccctgctctgcgacatcggggagagctcccccaaccccaccatcgaggccggccgcaccctgcgggtgctgaacctcgtcgagaactggctgaacaacaacacccagttctgcatcaaggtgctgaacccgtacatgcccagcgtgatcgagaagatggagacgctgcagcgcaagtacggcggggccctcgtccgcaaccccctgtcccggaacagcacccacgagatgtactgggtgtccaacgccaccggcaacatcgtgagctccgtcaacatgatcagccgcatgctgatcaaccggttcaccatgaagcacaagaaggccacgtacgagccggacgtggacctcgggtccggcacccgcaacatcgggatcgagagcgagatccccaacctggcgatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctcaccaagccctgggacgtggtcccgatggtgacccagatggccatgacggacaccacccccttcgggcagcagcgggtgttcaaggagaaggtcgacacccgcacgcaggagcccaaggagggcaccaagaagctgatgcggatcaccgccgagtggctgtggaaggagctcggcaagaagaagacgccccgcatgtgcacgcgggaggagttcacccgcaaggtgcggagcaacgcggccctgggggccatcttcaccgacgagaacaagtggaagtccgcccgcgaggccgtggaggacagccggttctgggagctggtcgaccgcgagcggaacctccacctggagggcaagtgcgagacctgcgtgtacaacatgatggggaagcgcgagaagaagctgggcgagttcgggaaggcgaagggctcccgggccatctggtacatgtggctcggcgcccgcttcctggagttcgaggccctggggttcctcaacgaggaccactggttcagccggggcaacagcctgtccggggtcgagggcgaggggctgcaccgcctcggctacatcctgcgcgacgtgagcaagaaggagggcggggcgatgtacgccgacgacacggccggctgggacacccggatcaccctggaggacctcaagaacgaggagatggtgaccaaccacatgaagggggagcacaagaagctggccgaggccgtcttcaagctgacgtaccagaacaaggtggtgcgcgtccagcggccgacgccccgcggcaccgtgatggacatcatctcccggcgcgaccagcgggggagcggccaggtgggcacctacgggctcaacaccttcaccaacatggaggcgcagctgatccgccagatggagggcgaggggatcttcaagtccatccagcacctgaccgccaccgaggagatcgccgtccagaactggctcgcccgggtgggccgcgagcggctgagccgcatggccatctccggcgacgactgcgtggtcaagcccctggacgaccggttcgcgagcgccctcacggccctgaacgacatggggaaggtgcgcaaggacatccagcagtgggagccctcccggggctggaacgactggacccaggtgccgttctgcagccaccacttccacgagctggtcatgaaggacgggcgcgtgctcgtggtcccctgccggaaccaggacgagctgatcggccgcgcccggatctcccagggggccggctggagcctgaaggagaccgcgtgcctcggcaagtcctacgcccagatgtggaccctgatgtacttccaccgccgcgacctgcggctcgccgccaacgccatctgcagcgcggtgccctcccactgggtgcccaccagccgcacgacctggtccatccacgccaagcacgagtggatgaccaccgaggacatgctggccgtctggaaccgggtgtggatccaggagaacccgtggatggaggacaagacgcccgtggagagctgggaggaggtcccctacctggggaagcgcgaggaccagtggtgcggcagcctcatcgggctgacctcccgggccacctgggcgaagaacatccagaccgccatcaaccaggtgcgcagcctgatcggcaacgaggagtacacggactacatgccctccatgaagcggttccgccgggaggaggaggaggccggggtgctctggtga

SEQ ID NO: 9311 - RNA, 9876 nt, synthetic construct
  misc_feature 1..9876: note = derived and/or modified CDS sequence (opt1) from DENV-2__KC294218__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcctgatcctgctcaccgccgtggcgcccagcatgaccatgcgctgcatcggcatctccaaccgggacttcgtcgagggcgtgagcgggggctcctgggtggacatcgtcctggagcacgggagctgcgtgaccacgatggccaagaacaagcccaccctggacttcgagctcatcaagaccgaggccaagcagcccgccaccctgcgcaagtactgcatcgaggccaagctgacgaacaccaccaccgagtcccggtgcccgacgcagggcgagcccagcctcaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctcacggggtacggcaccgtgaccatggagtgcagcccccggaccggcctggacttcaacgagatggtgctgctccagatggaggacaaggcctggctggtccaccggcagtggttcctggacctccccctgccctggctgccgggggccgacacgcagggcagcaactggatccagaaggagaccctcgtgaccttcaagaacccccacgcgaagaagcaggacgtggtcgtgctggggtcccaggagggcgccatgcacaccgccctgacgggggccaccgagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctcgagaagcggcacgtcctggggcgcctgatcaccgtgaacccgatcgtgacggagaaggacagccccgtcaacatcgaggcggagccgcccttcggcgactcctacatcatcgtgggggtggagccgggccagctcaagctgaactggttcaagaaggggagctccatcggccagatgttcgagaccaccatgcgcggcgccaagcggatggccatcctgggggacaccgcctgggacttcggcagcctcgggggcgtcttcacgtccatcgggaaggccctgcaccaggtgttcggcgcgatctacggcgccgccttcagcggggtgtcctggaccatgaagatcctgatcggcgtcatcatcacctggatcgggatgaacagccgctccaccagcctgtccgtgagcctcgtgctggtcggcgtggtgacgctgtacctcggggccatggtccaggcggactccggctgcatcgtgagctggaagaacaaggagctgaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctcgagaacctgatgtggaagcagatcacccccgagctgaaccacatcctctccgagaacgaggtgaagctgaccatcatgaccggcgacatcaaggggatcatgcaggccggcaagcggagcctgcgcccgcagcccacggagctcaagtactcctggaagacctggggcaaggcgaagatgctgagcaccgagtcccacaaccagaccttcctgatcgacgggcccgagacggccgagtgcccgaacaccaaccgggcctggaacagcctcgaggtggaggactacggcttcggggtcttcaccaccaacatctggctgaagctgcgcgagaagcaggacgtgttctgcgactccaagctcatgagcgccgccatcaaggacaaccgggcggtgcacgccgacatgggctactggatcgagtccgccctgaacgacacctggaagatggagaaggccagcttcatcgaggtcaagtcctgccactggcccaagagccacacgctgtggtccaacggcgtgctcgagagcgagatgatcatccccaagaacttcgccgggcccgtgtcccagcacaactaccgcccgggctaccacacccagaccgcggggccctggcacctgggcaagctggagatggacttcgacttctgcgaggggaccacggtcgtggtgaccgaggactgcggcaaccggggccccagcctccgcaccaccacggccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacgcgcgtcggcaccaagcacgcgatcctcctggtggccctgagcttcgtgaccctcatcaccgggaacatgtccttccgggacctgggccgcgtcatggtgatggtgggggccacgatgaccgacgacatcggcatgggcgtcacctacctggccctcctggccgcgttcaaggtgcgccccaccttcgccgccgggctgctcctgcggaagctgacgagcaaggagctcatgatggccaccatcggcatcgccctgctgtcccagagcaccctccccgagaccatcctggagctgacggacgcgctcgccctggggatgatggccctgaagatcgtgcgcaacatggagaagtaccagctcgccgtcaccatcatggccatctcctgcgtgccgaacgcggtgatcctgcagaacgcctggaaggtcagctgcaccatcctggccgccgtgtccgtgagccccctcctgctgacctccagccagcagaaggcggactggatccccctcgccctgacgatcaagggcctgaaccccaccgccatcttcctcaccaccctgtcccggacgagcaagaagcgctcctggccgctgaacgaggccatcatggccgtcggcatggtgagcatcctcgcgtccagcctgctgaagaacgacatccccatgaccgggcccctcgtcgccggcgggctgctgaccgtgtgctacgtgctcaccggccggagcgccgacctggagctggagcgcgccgccgacgtcaagtgggaggaccaggcggagatctccgggagctcccccatcctcagcatcacgatctccgaggacggcagcatgtccatcaagaacgaggaggaggagcagaccctgaccatcctgatccggaccggcctcctggtgatcagcggggtgttcccggtctccatccccatcaccgccgccgcctggtacctgtgggaggtgaagaagcagcgcgccggcgtgctctgggacgtccccagcccgccgcccgtggggaaggcggagctggaggacggcgcctaccggatcaagcagcgcgggatcctgggctactcccagatcggcgccggggtgtacaaggagggcacgttccacaccatgtggcacgtcacccgcggggccgtgctcatgcaccgcggcaagcggatcgagcccagctgggccgacgtgaagaaggacctgatctcctacgggggcggctggaagctggagggggagtggaaggagggcgaggaggtccaggtgctcgcgctggagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctctacggcaacggcgtggtgacgcgcagcggggcctacgtctccgcgatcgcccagaccgagaagtccatcgaggacaaccccgagatcgaggacgacatcttccggaagaagcgcctgaccatcatggacctgcaccccggcgccgggaagaccaagcggtacctgcccgccatcgtgcgcgaggccatcaagcggggcctccgcacgctgatcctggcgccgacccgcgtggtcgccgccgagatggaggaggccctccgggggctgcccatccgctaccagacccccgccatccgggcggagcacaccggccgcgagatcgtggacctgatgtgccacgccacgttcaccatgcggctcctgagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctccgcaagaacggcaagaaggtgatccagctgagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctcgccgggcccatgccggtcacccactccagcgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacccccgagggcatcatcccgtccatgttcgagcccgagcgcgagaaggtggacgccatcgacggggagtaccggctgcgcggcgaggcccggaagaccttcgtggacctgatgcgccgcggggacctccccgtctggctggcctacaaggtggcggccgagggcatcaactacgccgaccgcaagtggtgcttcgacgggatcaagaacaaccagatcctggaggagaacgtggaggtcgagatctggacgaaggagggcgagcggaagaagctcaagccgcgctggctggacgcccggatctacagcgaccccctggcgctcaaggagttcaaggagttcgccgccggccgcaagtccctgaccctgaacctcatcaccgagatggggcggctgcccaccttcatgacgcagaaggcccgcaacgccctggacaacctcgcggtgctgcacaccgccgaggtgggcgggaaggcctacacccacgccctgagcgagctccccgagaccctggagacgctgctcctgctgaccctcctggccgcggtcaccggcggcatcttcctgttcctcatgtccgggaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgcgatcctcaccgtggtcgccgccaccatggccaacgagatggggttcctggagaagacgaagaaggacctgggcttcggcagcatcaccacccaggagagcgagtccaacatcctcgacatcgacctgcgcccggccagcgcgtggaccctgtacgccgtggccacgaccttcgtgacccccatgctccggcactccatcgagaacagctccgtcaacgtgagcctgaccgccatcgcgaaccaggccacggtgctgatggggctcggcaaggggtggcccctgtccaagatggacatcggcgtccccctgctcgccatcgggtgctacagccaggtgaacccgatcaccctgaccgccgccctgctcctgctggtggcgcactacgccatcatcggccccggcctccaggccaaggccacccgcgaggcccagaagcgggcggccgccgggatcatgaagaaccccacggtcgacggcatcaccgtgatcgacctggagcccatcccgtacgaccccaagttcgagaagcagctggggcaggtcatgctcctgatcctgtgcgtcacccaggtgctcatgatgcgcaccacgtgggccctgtgcgaggccctgaccctcgcgaccggccccatctccaccctgtgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctcaacgccctgggcaagagcgagttccagatctacaagaagtccgggatccaggaggtggaccggaccctggccaaggagggcatcaagcgcggggagacggaccaccacgccgtgagccggggctccgccaagctccgctggttcgtcgagcggaacatggtgaccccggagggcaaggtggtcgacctggggtgcggccgcgggggctggagctactactgcgggggcctgaagaacgtgcgggaggtgaagggcctcaccaagggcgggcccgggcacgaggagcccatccccatgtccacctacggctggaacctggtccgcctgcagagcggggtggacgtgttcttcacgccgcccgagaagtgcgacaccctcctgtgcgacatcggcgagagctcccccaaccccaccatcgaggcgggccggaccctgcgcgtcctcaacctggtggagaactggctgaacaacaacacccagttctgcatcaaggtgctcaacccgtacatgcccagcgtcatcgagaagatggagacgctgcagcggaagtacgggggcgccctggtgcgcaaccccctgtcccggaacagcacccacgagatgtactgggtgtccaacgccaccgggaacatcgtcagctccgtgaacatgatcagccgcatgctcatcaaccggttcaccatgaagcacaagaaggccacgtacgagccggacgtggacctgggctccgggacccgcaacatcggcatcgagagcgagatccccaacctggacatcgtcggcaagcggatcgagaagatcaagcaggagcacgagacctcctggcactacgaccaggaccacccctacaagacctgggcctaccacgggagctacgagacgaagcagaccggctccgcgagctccatggtgaacggggtggtccgcctcctgaccaagccctgggacgtggtgccgatggtcacccagatggccatgacggacaccacccccttcggccagcagcgcgtgttcaaggagaaggtggacacccggacgcaggagcccaaggagggcaccaagaagctgatgaagatcaccgccgagtggctctggaaggagctggggaaggagaagacgccccggatgtgcacgcgggaggagttcacccgcaaggtccggagcaacgccgccctgggcgcggtgttcaccgacgagaacaagtggaagtccgcccgcgaggccgtggaggacgggcggttctgggagctcgtcgaccgcgagcggaacctgcacctggagggcaagtgcgagacctgcgtgtacaacatgatggggaagcgcgagaagaagctcggcgagttcggcaaggccaaggggagccgggcgatctggtacatgtggctgggcgcccgcttcctggagttcgaggccctcgggttcctgaacgaggaccactggttctcccggggcaacagcctgagcggggtcgagggcgagggcctccaccgcctggggtacatcctgcgggaggtgggcaagaaggagggcggcgccatgtacgccgacgacacggcggggtgggacacccgcatcaccctcgaggacctgaagaacgaggagatggtgaccaaccacatgaagggcgagcacaagaagctggccgaggccatcttcaagctcacgtaccagaacaaggtcgtgcgggtgcagcgcccgacgccccggggcaccgtcatggacatcatctcccgcaaggaccagcgggggagcggccaggtggggacctacggcctgaacacgttcaccaacatggaggcccagctgatccgccagatggagggcgaggggatcttcaagtccatccagcacctcaccgccaccgaggagatcgcggtgcagaactggctggcccgcgtcggccgggagcgcctgagccggatggccatctccggggacgactgcgtggtgaagcccatcgacgaccgcttcgccagcgccctcacggcgctgaacgacatgggcaaggtccggaaggacatccagcagtgggagccctcccgcgggtggaacgactggacccaggtgccgttctgcagccaccacttccacgagctggtgatgaaggacggccgggtcctcgtggtgccctgccgcaaccaggacgagctgatcggccgggcccgcatctcccagggggccggctggagcctgaaggagaccgcctgcctcgggaagtcctacgcccagatgtggaccctgatgtacttccaccggcgcgacctgcggctcgcggccaacgccatctgcagcgccgtcccctcccactgggtgcccaccagccgcacgacctggtccatccacgcgaagcacgagtggatgaccaccgaggacatgctggtggtctggaaccgggtgtggatccaggagaacccgtggatggaggacaagacgcccgtggagagctgggaggaggtcccctacctgggcaagcgcgaggaccagtggtgcgggtccctcatcggcctgaccagccgggccacctgggccaagaacatccagaccgccatcaaccaggtgcgcagcctgatcggcaacgaggggtacacggactacatgccctccatgaagcggttccgccgcgaggaggaggaggccggcgtgctctggtga

SEQ ID NO: 9312 - RNA, 9876 nt, synthetic construct
  misc_feature 1..9876: note = derived and/or modified CDS sequence (opt1) from DENV-2__KC294220__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagatgtgcgacaccctgctctgcgacatcggcgagagctcccccaaccccaccatcgaggcgggccggaccctgcgcgtcctgaacctcgtggagaactggctgaacaacaacacccagttctgcatcaaggtgctgaacccgtacatgcccagcgtcatcgagaagatggagacgctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagagcgagatccccaacctggacatcgtcggcaagcggatcgagaagatcaagcaggagcacgagacctcctggcactacgaccaggaccacccctacaagacctgggcctaccacgggagctacgagacgaagcagaccggctccgcgagctccatggtgaacggggtggtccgcctgctcaccaagccctgggacgtggtgccgatggtcacccagatggccatgacggacaccacccccttcggccagcagcgcgtgttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtccggagcaacgccgccctgggcgcggtgttcaccgacgagaacaagtggaagtccgcccgcgaggccgtggaggacgggcggttctgggagctggtcgaccgcgagcggaacctccacctggagggcaagtgcgagacctgcgtgtacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtcgagggcgagggcctgcaccgcctcgggtacatcctgcgggaggtgggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtcgtgcgggtgcagcgcccgacgccccggggcaccgtcatggacatcatctcccgcaaggaccagcgggggagcggccaggtggggacctacggcctcaacacgttcaccaacatggaggcccagctgatccgccagatggagggcgaggggatcttcaagtccatccagcacctgaccgccaccgaggagatcgcggtgcagaactggctcgcccgcgtcggccgggagcgcctgagccggatggccatctccggggacgactgcgtggtgaagcccatcgacgaccgcttcgccagcgccctgacggcgctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtcccctcccactgggtgcccaccagccgcacgacctggtccatccacgcgaagcacgagtggatgaccaccgaggacatgctcgtggtctggaaccgggtgtggatccaggagaacccgtggatggaggacaagacgcccgtggagagctgggaggaggtcccctacctgggcaagcgcgaggaccagtggtgcgggtccctgatcggcctcaccagccgggccacctgggccaagaacatccagaccgccatcaaccaggtgcgcagcctgatcggcaacgaggggtacacggactacatgccctccatgaagcggttccgccgcgaggaggaggaggccggcgtgctgtggtga

SEQ ID NO: 9313 - RNA, 9876 nt, synthetic construct
  misc_feature 1..9876: note = derived and/or modified CDS sequence (opt1) from DENV-2__KC294221__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacgtacgggacctgcaccaccacgggcgagcaccggcgcgagaagcggtccgtggccctggtgccccacgtcgggatgggcctcgagacccggaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcgcggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccgccagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccggctgcgcatggacaagctccagctgaaggggatgtcctacagcatgtgcaccggcaagttcaagatcgtcaaggagatcgccgagacgcagcacgggaccatcgtgatccgggtgcagtacgagggcgacggctccccctgcaagatccccttcgagatcaccgacctggagaagcgccacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcggggcgccaagcgcatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccggtccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccgcagcgtcacgcggctggagaacctcatgtggaagcagatcacccccgagctgaaccacatcctgtccgagaacgaggtgaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtggaggactacggcttcggggtcttctccaccaacatctggctcaagctgcgggagaagcaggacgtgttctgcgacagcaagctgatgtccgccgccatcaaggacaaccgcgcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccggccgggctaccacacgcagaccgcggggccctggcacctcggcaagctggagatggacttcgacttctgcgaggggaccaccgtcgtggtgacggaggactgcggcaaccgcggccccagcctgcggaccaccaccgcctccgggaagctcatcacggagtggtgctgccgcagctgcaccctgcccccgctgcggtaccgcggcgaggacgggtgctggtacggcatggagatccggcccctcaaggagaaggaggagaacctggtcaactccctggtgaccgccgggcacggccagatcgacaacttcagcctcggcgtgctggggatggccctgttcctcgaggagatgctgcgcacccgggtcggcacgaagcacgcgatcctgctcgtggccctgtccttcgtgaccctgatcaccgggaacatgagcttccgcgacctcggccgcgtcatggtgatggtgggggccaccatgacggacgacatcggcatgggcgtcacctacctggccctgctcgccgcgttcaaggtgcggcccaccttcgccgccgggctgctgctccgcaagctgacctccaaggagctgatgatggccacgatcggcatcgccctcctgagccagtccaccctgcccgagaccatcctcgagctgaccgacgcgctggccctcgggatgatggccctgaagatcgtgcggaacatggagaagtaccagctggccgtcacgatcatggccatcagctgcgtgccgaacgcggtgatcctccagaacgcctggaaggtctcctgcaccatcctggccgccgtgagcgtgagccccctgctcctgaccagctcccagcagaaggcggactggatccccctggccctcaccatcaagggcctgaaccccacggccatcttcctgaccaccctcagccgcacctccaagaagcggagctggccgctgaacgaggccatcatggccgtcggcatggtgtccatcctggcgagcagcctcctgaagaacgacatccccatgacggggcccctggtcgccggcgggctcctgaccgtgtgctacgtgctgaccggccgctccgccgacctcgagctggagcgggccgccgacgtcaagtgggaggaccaggcggagatcagcgggtccagccccatcctgtccatcaccatcagcgaggacggctccatgagcatcaagaacgaggaggaggagcagacgctcaccatcctgatccgcaccggcctgctcgtgatctccggggtgttcccggtcagcatccccatcaccgccgccgcctggtacctgtgggaggtgaagaagcagcgggccggcgtgctgtgggacgtccccagcccgccgcccgtggggaaggcggagctcgaggacggcgcctaccgcatcaagcagcgggggatcctgggctacagccagatcggcgccggggtgtacaaggagggcaccttccacacgatgtggcacgtcacccgcggggccgtgctgatgcaccggggcaagcgcatcgagccctcctgggccgacgtgaagaaggacctcatcagctacgggggcggctggaagctggagggggagtggaaggagggcgaggaggtccaggtgctggcgctcgagcccgggaagaacccccgggccgtgcagaccaagcccggcatcttcaagaccaacacggggaccatcggcgccgtctccctggacttcagccccggcacctccgggagccccatcgtggaccgcaagggcaaggtggtcgggctgtacggcaacggcgtggtgacccggtccggggcctacgtcagcgcgatcgcccagacggagaagtccatcgaggacaaccccgagatcgaggacgacatcttccgcaagaagcggctcaccatcatggacctgcaccccggcgccgggaagaccaagcgctacctgcccgccatcgtgcgggaggccatcaagcgcggcctgcgcaccctcatcctggcgccgacgcgggtggtcgccgccgagatggaggaggccctgcgcgggctccccatccggtaccagacccccgccatccgcgcggagcacaccggccgggagatcgtggacctgatgtgccacgccaccttcacgatgcgcctgctctcccccgtgcgggtcccgaactacaacctgatcatcatggacgaggcccacttcaccgaccccgccagcatcgccgcgcgcggctacatctccacccgggtggagatgggggaggccgccggcatcttcatgaccgccacgccgcccgggagccgcgacccgttcccccagtccaacgcgcccatcatggacgaggagcgggagatccccgagcgcagctggaactccggccacgagtgggtgaccgacttcaaggggaagaccgtctggttcgtgccgagcatcaaggccggcaacgacatcgccgcctgcctgcggaagaacggcaagaaggtgatccagctctcccgcaagaccttcgacagcgagtacgtcaagacgcgggccaacgactgggacttcgtggtgaccaccgacatctccgagatgggggcgaacttcaaggccgagcgcgtcatcgacccccggcgctgcatgaagcccgtgatcctgaccgacggcgaggagcgggtgatcctggccgggcccatgccggtcacgcacagctccgccgcccagcgccgcggccggatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgggagaaggtggacgccatcgacggggagtaccgcctccggggcgaggcccgcaagaccttcgtggacctgatgcggcgcggggacctgcccgtctggctcgcctacaaggtggcggccgagggcatcaactacgccgaccggaagtggtgcttcgacgggatcaagaacaaccagatcctggaggagaacgtggaggtcgagatctggaccaaggagggcgagcgcaagaagctgaagccgcggtggctcgacgcccgcatctactccgaccccctggcgctgaaggagttcaaggagttcgccgccggccggaagtccctcacgctgaacctgatcaccgagatggggcgcctccccaccttcatgacccagaaggcccggaacgccctggacaacctggcggtgctccacacggccgaggtgggcgggaaggcctacacccacgccctgtccgagctgcccgagaccctcgagaccctgctgctcctgacgctgctcgccgcggtcaccggcggcatcttcctgttcctgatgagcgggaagggcatcgggaagatgaccctcggcatgtgctgcatcatcaccgcctccatcctgctgtggtacgcccagatccagccgcactggatcgccgccagcatcatcctcgagttcttcctgatcgtgctgctcatccccgagcccgagaagcagcgcacgccccaggacaaccagctgacgtacgtcgtgatcgcgatcctgaccgtggtcgccgccaccatggccaacgagatggggttcctcgagaagaccaagaaggacctgggcttcggcagcatcacgacccaggagtccgagagcaacatcctggacatcgacctccggccggcctccgcgtggaccctgtacgccgtggccaccacgttcgtgacccccatgctgcgccacagcatcgagaactccagcgtcaacgtgtccctcaccgccatcgcgaaccaggccaccgtgctgatggggctgggcaaggggtggcccctcagcaagatggacatcggcgtccccctgctggccatcgggtgctactcccaggtgaacccgatcacgctcaccgccgccctgctgctcctggtggcgcactacgccatcatcggccccggcctgcaggccaaggccacccgggaggcccagaagcgcgcggccgccgggatcatgaagaaccccaccgtcgacggcatcacggtgatcgacctcgagcccatcccgtacgaccccaagttcgagaagcagctggggcaggtcatgctgctcatcctgtgcgtcacccaggtgctgatgatgcggaccacctgggccctctgcgaggccctgacgctggcgaccggccccatcagcaccctctgggaggggaaccccggccgcttctggaacaccacgatcgccgtgtccatggccaacatcttccgcggcagctacctggccggggcgggcctcctgttctccatcatgaagaacaccaccaacacccggcgcgggacgggcaacgtcggcgagaccctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgccaagctgcggtggttcgtcgagcgcaacatggtgacgccggagggcaaggtggtcgacctcgggtgcggccgcggcgggtggtcctactactgcggcgggctgaagaacgtgcgcgaggtgaaggggctgaccaagggcggccccgggcacgaggagcccatccccatgagcacctacggctggaacctcgtccggctgcagagcggggtggacgtgttcttcaccccgcccgagaagtgcgacacgctgctctgcgacatcggcgagtccagccccaaccccaccatcgaggcgggccgcaccctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacgcacgagatgtactgggtgagcaacgccaccgggaacatcgtctccagcgtgaacatgatctcccggatgctgatcaaccgcttcaccatgaagcacaagaaggccacctacgagccggacgtggacctcggcagcgggacgcggaacatcggcatcgagtccgagatccccaacctggacatcgtcggcaagcgcatcgagaagatcaagcaggagcacgagaccagctggcactacgaccaggaccacccctacaagacctgggcctaccacgggtcctacgagaccaagcagacgggcagcgcgtccagcatggtgaacggggtggtccgcctgctcaccaagccctgggacgtggtgccgatggtcacccagatggccatgaccgacacgacccccttcggccagcagcgggtgttcaaggagaaggtggacacccgcacccaggagcccaaggagggcacgaagaagctgatgaagatcaccgccgagtggctgtggaaggagctcgggaaggagaagacgccccggatgtgcacccgcgaggagttcacgcggaaggtccgctccaacgccgccctgggcgcggtgttcaccgacgagaacaagtggaagtccgcccgggaggccgtggaggacgggcgcttctgggagctggtcgaccgggagcgcaacctccacctggagggcaagtgcgagacctgcgtgtacaacatgatggggaagcgggagaagaagctgggcgagttcggcaaggccaaggggtcccgcgcgatctggtacatgtggctcggcgcccggttcctggagttcgaggccctggggttcctcaacgaggaccactggttcagccgcggcaacagcctgtccggggtcgagggcgagggcctgcaccggctcgggtacatcctgcgcgaggtgggcaagaaggagggcggcgccatgtacgccgacgacaccgcggggtgggacacgcggatcaccctggaggacctcaagaacgaggagatggtgaccaaccacatgaagggcgagcacaagaagctggccgaggccatcttcaagctgacctaccagaacaaggtcgtgcgcgtgcagcggccgacgccccgcggcaccgtcatggacatcatcagccggaaggaccagcgcgggtccggccaggtggggacctacggcctcaacaccttcacgaacatggaggcccagctgatccgccagatggagggcgaggggatcttcaagagcatccagcacctgaccgccaccgaggagatcgcggtgcagaactggctcgcccgggtcggccgcgagcggctgtcccgcatggccatcagcggggacgactgcgtggtgaagcccatcgacgaccggttcgcctccgccctgaccgcgctcaacgacatgggcaaggtccgcaaggacatccagcagtgggagcccagccgggggtggaacgactggacccaggtgccgttctgctcccaccacttccacgagctggtgatgaaggacggccgcgtcctggtggtgccctgccggaaccaggacgagctcatcggccgcgcccggatcagccagggggccggctggtccctgaaggagaccgcctgcctgggcaagagctacgcccagatgtggaccctcatgtacttccaccgccgggacctgcgcctggcggccaacgccatctgctccgccgtccccagccactgggtgcccacctcccggaccacgtggagcatccacgcgaagcacgagtggatgaccaccgaggacatgctcgtggtctggaaccgcgtgtggatccaggagaacccgtggatggaggacaagacccccgtggagtcctgggaggaggtcccctacctgggcaagcgggaggaccagtggtgcgggagcctgatcggcctcacgagccgcgccacctgggccaagaacatccagaccgccatcaaccaggtgcggtccctgatcggcaacgaggggtacaccgactacatgcccagcatgaagcgcttccgccgggaggaggaggaggccggcgtgctgtggtga

SEQ ID NO: 9314 - RNA, 9876 nt, synthetic construct
  misc_feature 1..9876: note = derived and/or modified CDS sequence (opt1) from DENV-2__KC294223__SS-prME
  source 1..9876: mol_type = other RNA
accgccggcgtgatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcgacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggccctgaagatcgtgcgcaacatggagaagtaccagctggccgtcaccatcatggccatctcctgcgtgccgaacgcggtgatcctccagaacgcctggaaggtcagctgcaccatcctggccgccgtgtccgtgagccccctgctcctgacctccagccagcagaaggcggactggatccccctggccctcacgatcaagggcctgaaccccaccgccatcttcctgaccaccctctcccggacgagcaagaagcgctcctggccgctgaacgaggccatcatggccgtcggcatggtgagcatcctggcgtccagcctcctgaagaacgacatccccatgaccgggcccctggtcgccggcgggctcctgaccgtgtgctacgtgctgaccggccggagcgccgacctcgagctggagcgcgccgccgacgtcaagtgggaggaccaggcggagatctccgggagctcccccatcctgagcatcacgatctccgaggacggcagcatgtccatcaagaacgaggaggaggagcagaccctcaccatcctgatccggaccggcctgctcgtgatcagcggggtgttcccggtctccatccccatcaccgccgccgcctggtacctgtgggaggtgaagaagcagcgcgccggcgtgctgtgggacgtccccagcccgccgcccgtggggaaggcggagctcgaggacggcgcctaccggatcaagcagcgcgggatcctgggctactcccagatcggcgccggggtgtacaaggagggcacgttccacaccatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggcgctcgagcccgggaagaacccccgcgccgtgcagaccaagcccggcatcttcaagacgaacaccgggaccatcggcgccgtcagcctggacttctcccccggcaccagcgggtcccccatcgtggaccggaagggcaaggtggtcgggctgtacggcaacggcgtggtgacgcgcagcggggcctacgtctccgcgatcgcccagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggcgccgacccgcgtggtcgccgccgagatggaggaggccctgcgggggctccccatccgctaccagacccccgccatccgggcggagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcggggctacatcagcacccgcgtggagatgggggaggccgccggcatcttcatgacggccacgccgcccgggtcccgggacccgttcccccagagcaacgcgcccatcatggacgaggagcgcgagatccccgagcggtcctggaacagcggccacgagtgggtgaccgacttcaaggggaagaccgtctggttcgtgccgtccatcaaggccggcaacgacatcgccgcctgcctgcgcaagaacggcaagaaggtgatccagctcagccggaagacgttcgactccgagtacgtcaagacccgcgccaacgactgggacttcgtggtgaccaccgacatcagcgagatgggggcgaacttcaaggccgagcgggtcatcgacccccgccggtgcatgaagcccgtgatcctgacggacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctacaaggtggcggccgagggcatcaactacgccgaccgcaagtggtgcttcgacgggatcaagaacaaccagatcctggaggagaacgtggaggtcgagatctggacgaaggagggcgagcggaagaagctgaagccgcgctggctcgacgcccggatctacagcgaccccctggcgctgaaggagttcaaggagttcgccgccggccgcaagtccctcaccctgaacctgatcaccgagatggggcggctccccaccttcatgacgcagaaggcccgcaacgccctggacaacctggcggtgctccacaccgccgaggtgggcgggaaggcctacacccacgccctgagcgagctgcccgagaccctcgagacgctgctgctcctgaccctgctcgccgcggtcaccggcggcatcttcctgttcctgatgtccgggaagggcatcgggaagatgaccctcggcatgtgctgcatcatcaccgccagcatcctgctgtggtacgcccagatccagccgcactggatcgccgcctccatcatcctcgagttcttcctgatcgtgctgctcatccccgagcccgagaagcagcggacgccccaggacaaccagctgacctacgtcgtgatcgcgatcctgaccgtggtcgccgccaccatggccaacgagatggggttcctcgagaagacgaagaaggacctgggcttcggcagcatcaccacccaggagagcgagtccaacatcctggacatcgacctccgcccggccagcgcgtggaccctgtacgccgtggccacgaccttcgtgacccccatgctgcggcactccatcgagaacagctccgtcaacgtgagcctcaccgccatcgcgaaccaggccacggtgctgatggggctgggcaaggggtggcccctctccaagatggacatcggcgtccccctgctggccatcgggtgctacagccaggtgaacccgatcaccctcaccgccgccctgctgctcctggtggcgcactacgccatcatcggccccggcctgcaggccaaggccacccgcgaggcccagaagcgggcggccgccgggatcatgaagaaccccacggtcgacggcatcaccgtgatcgacctcgagcccatcccgtacgaccccaagttcgagaagcagctggggcaggtcatgctgctcatcctgtgcgtcacccaggtgctgatgatgcgcaccacgtgggccctctgcgaggccctgaccctggcgaccggccccatctccaccctctgggaggggaaccccggccggttctggaacacgaccatcgccgtgagcatggccaacatcttccgcggctcctacctggccggggcgggcctcctgttcagcatcatgaagaacaccaccaacacgcgccgggggaccggcaacgtcggcgagaccctgggggagaagtggaagtcccgcctgaacgccctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcggccccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaacaacacccagttctgcatcaaggtgctgaacccgtacatgcccagcgtcatcgagaagatggagacgctccagcggaagtacgggggcgccctggtgcgcaaccccctgtcccggaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagagcgagatccccaacctggacatcgtcggcaagcggatcgagaagatcaagcaggagcacgagacctcctggcactacgaccaggaccacccctacaagacctgggcctaccacgggagctacgagacgaagcagaccggctccgcgagctccatggtgaacggggtggtccgcctgctcaccaagccctgggacgtggtgccgatggtcacccagatggccatgacggacaccacccccttcggccagcagcgcgtgttcaaggagaaggtggacacccggacgcaggagcccaaggagggcaccaagaagctgatgaagatcaccgccgagtggctgtggaaggagctcgggaaggagaagacgccccggatgtgcacgcgggaggagttcacccgcaaggtccggagcaacgccgccctgggcgcggtgttcaccgacgagaacaagtggaagtccgcccgcgaggccgtggaggacgggcggttctgggagctggtcgaccgcgagcggaacctccacctggagggcaagtgcgagacctgcgtgtacaacatgatggggaagcgcgagaagaagctgggcgagttcggcaaggccaaggggagccgggcgatctggtacatgtggctcggcgcccgcttcctggagttcgaggccctggggttcctcaacgaggaccactggttctcccggggcaacagcctgagcggggtcgagggcgagggcctgcaccgcctcgggtacatcctgcgggaggtgggcaagaaggagggcggcgccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtcgtgcgggtgcagcgcccgacgccccggggcaccgtcatggacatcatctcccgcaaggaccagcgggggagcggccaggtggggacctacggcctcaacacgttcaccaacatggaggcccagctgatccgccagatggagggcgaggggatcttcaagtccatccagcacctgaccgccaccgaggagatcgcggtgcagaactggctcgcccgcgtcggccgggagcgcctgagccggatggccatctccggggacgactgcgtggtgaagcccatcgacgaccgcttcgccagcgccctgacggcgctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcggccgggcccgcatctcccagggggccggctggagcctgaaggagaccgcctgcctggggaagtcctacgcccagatgtggaccctcatgtacttccaccggcgcgacctgcggctggcggccaacgccatctgcagcgccgtcccctcccactgggtgcccaccagccgcacgacctggtccatccacgcgaagcacgagtggatgaccaccgaggacatgctcgtggtctggaaccgggtgtggatccaggagaacccgtggatggaggacaagacgcccgtggagagctgggaggaggtcccctacctgggcaagcgcgaggaccagtggtgcgggtccctgatcggcctcaccagccgggccacctgggccaagaacatccagaccgccatcaaccaggtgcgcagcctgatcggcaacgaggggtacacggactacatgccctccatgaagcggttccgccgcgaggaggaggaggccggcgtgctgtggtga

SEQ ID NO: 9315 - RNA, 9876 nt, synthetic construct
  misc_feature 1..9876: note = derived and/or modified CDS sequence (opt1) from DENV-2__FJ906959__SS-prME
  source 1..9876: mol_type = other RNA
accgccggcatgatcatcatgctgatccccaccgtgatggccttccacctcaccacccggaacggggagccccacatgatcgtcagccggcaggagaagggcaagtccctgctgttcaagaccgaggacggggtgaacatgtgcaccctcatggcgatggacctgggcgagctgtgcgaggacaccatcacctacaagtgccccttcctcaagcagaacgagcccgaggacatcgactgctggtgcaacagcacctccacctgggtgacgtacgggacctgcaccaccacgggcgagcaccgccgggagaagcgcagcgtcgccctggtgccccacgtgggcatggggctggagacccggaccgagacctggatgtccagcgagggcgcctggaagcacgcccagcgcatcgagacgtggatcctccggcacccggggttcaccatcatggccgcgatcctggcctacaccatcggcaccacgcacttccagcgcgccctgatcttcatcctcctgaccgccgtcgcgccctccatgaccatgcggtgcatcgggatcagcaaccgcgacttcgtggagggcgtgtccggcgggagctgggtcgacatcgtgctggagcacggctcctgcgtgaccacgatggccaagaacaagcccaccctcgacttcgagctgatcaagaccgaggccaagcagcccgccaccctgcggaagtactgcatcgaggccaagctcacgaacaccaccaccgacagccgctgcccgacgcagggggagccctccctgaacgaggagcaggacaagcggttcgtctgcaagcacagcatggtggaccgcggctggggcaacgggtgcggcctgttcgggaagggcgggatcgtgacctgcgcgatgttcacgtgcaagaagaacatgaagggcaaggtcgtgcagcccgagaacctcgagtacaccatcgtgatcacgccccactccggcgaggagcacgccgtcgggaacgacaccggcaagcacgggaaggagatcaagatcaccccgcagagctccatcaccgaggccgagctgaccggctacgggacggtgaccatggagtgcagcccccggaccggcctggacttcaacgagatggtgctcctgcagatggagaacaaggcctggctggtccaccgccagtggttcctcgacctgcccctgccctggctcccgggcgccgacacccaggggtccaactggatccagaaggagacgctggtgaccttcaagaacccccacgcgaagaagcaggacgtggtcgtgctgggcagccaggagggggccatgcacaccgccctcaccggcgccacggagatccagatgagctccgggaacctgctgttcaccggccacctcaagtgccggctgcgcatggacaagctgcagctcaagggcatgagctactccatgtgcaccgggaagttcaaggtcgtgaaggagatcgccgagacccagcacggcacgatcgtgatccgggtccagtacgagggggacggcagcccctgcaagatccccttcgagatcatggacctggagaagcgccacgtgctgggccggctcatcaccgtgaacccgatcgtcaccgagaaggactcccccgtgaacatcgaggcggagccgcccttcggggacagctacatcatcatcggcgtggagccggggcagctgaagctgaactggttcaagaagggctccagcatcgggcagatgatcgagaccacgatgcgcggcgccaagcgcatggccatcctcggcgacaccgcctgggacttcgggtccctgggcggggtcttcaccagcatcggcaaggccctgcaccaggtgttcggggcgatctacggcgccgccttctccggcgtgagctggatcatgaagatcctcatcggggtcatcatcacctggatcggcatgaactcccggagcacgtccctgagcgtgtccctggtgctggtcggggtggtgaccctctacctgggcgtcatggtgcaggccgacagcgggtgcgtggtctcctggaagaacaaggagctgaagtgcggcagcggcatcttcatcaccgacaacgtgcacacctggacggagcagtacaagttccagcccgagagcccctccaagctcgcgagcgccatccagaaggcccacgaggaggggatctgcggcatccgctccgtgacccggctggagaacctgatgtggaagcagatcacccccgagctcaaccacatcctgagcgagaacgaggtcaagctgaccatcatgacgggggacatcaagggcatcatgcaggccgggaagcgctccctccagccgcagcccaccgagctgaagtacagctggaagacctggggcaaggccaagatgctgtccaccgagagccacaaccagacgttcctcatcgacggccccgagaccgcggagtgcccgaacaccaaccgggcctggaactccctggaggtggaggactacgggttcggcgtgttcaccacgaacatctggctgaagctccgcgagaagcaggacgtcttctgcgacagcaagctgatgtccgccgccatcaaggacaaccgggccgtgcacgcggacatggggtactggatcgagagcgccctgaacgacacctggaagatcgagaaggcctccttcatcgaggtcaagagctgccactggcccaagtcccacaccctctggagcaacggcgtgctggagtccgagatgatcatccccaagaacttcgccggccccgtgagccagcacaactaccgcccggggtaccacacccagaccgccggcccctggcacctggggaagctcgagatggacttcgacttctgcgagggcacgaccgtggtcgtgaccgaggactgcgggaaccggggccccagcctgcgcaccacgaccgcgtccggcaagctgatcaccgagtggtgctgccggagctgcaccctcccgcccctgcgctaccgcggggaggacggctgctggtacgggatggagatccgccccctgaaggagaaggaggagaacctcgtgaactccctggtcacggccggccacgggcagatcgacaacttcagcctgggcgtgctcggcatggccctgttcctggaggagatgctccggacccgcgtggggaccaagcacgccatcctgctggtcgcggtgtccttcgtgaccctcatcacgggcaacatgagcttccgggacctggggcgcgtcatggtgatggtgggcgccaccatgaccgacgacatcgggatgggcgtcacctacctggccctcctggccgccttcaaggtgcggcccacgttcgcggccggcctgctcctgcgcaagctgacctccaaggagctcatgatgaccaccatcgggatcgtgctgctgagccagtccacgatccccgagaccatcctcgagctgaccgacgccctggccctcggcatgatggtcctgaagatggtgcgcaagatggagaagtaccagctggccgtgaccatcatggcgatcctctgcgtccccaacgccgtgatcctgcagaacgcctggaaggtcagctgcacgatcctggccgtggtgtccgtcagccccctcttcctgacctccagccagcagaaggccgactggatccccctggcgctcaccatcaaggggctgaaccccaccgccatcttcctgacgaccctctcccggaccaacaagaagcgcagctggccgctgaacgaggccatcatggccgtgggcatggtgtccatcctggcgagctccctcctgaagaacgacatccccatgaccggccccctggtcgccgggggcctcctgacggtgtgctacgtgctgaccgggcggagcgccgacctcgagctggagcgcgccgccgacgtcaagtgggaggaccaggcggagatcagcggctccagccccatcctgtccatcaccatcagcgaggacgggtccatgagcatcaagaacgaggaggaggagcagaccctcacgatcctgatccggaccggcctgctcgtgatctccggcctgttcccggtgagcatccccatcaccgccgccgcctggtacctgtgggaggtcaagaagcagcgcgccggggtgctctgggacgtgcccagcccgccgcccgtcggcaaggcggagctggaggacggggcctaccggatcaagcagaagggcatcctggggtacagccagatcggcgccggcgtgtacaaggaggggaccttccacaccatgtggcacgtgacgcgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagaccaagcccgggctgttcaagaccaacgccggcaccatcggggccgtgtccctcgacttcagccccggcacgtccggcagccccatcatcgacaagaaggggaaggtcgtgggcctgtacgggaacggcgtggtcacccggtccggcgcctacgtgagcgcgatcgcccagaccgagaagtccatcgaggacaaccccgagatcgaggacgacatcttccgcaagcggaagctgaccatcatggacctccaccccggggccggcaagacgaagcgctacctgcccgccatcgtgcgggaggcgatcaagcgcgggctgcggaccctgatcctcgccccgacccgcgtcgtggccgccgagatggaggaggccctgcggggcctgcccatccgctaccagacccccgcgatccgggccgagcacacggggcgcgagatcgtggacctcatgtgccacgccaccttcaccatgcgcctgctgagccccgtccgggtgccgaactacaacctcatcatcatggacgaggcccacttcaccgaccccgccagcatcgcggcccgcggctacatctccacgcgggtggagatgggcgaggccgccgggatcttcatgaccgccacgccgcccggcagccgcgacccgttcccccagtccaacgcgcccatcatggacgaggagcgggagatccccgagcgcagctggtccagcgggcacgagtgggtcaccgacttcaagggcaagacggtgtggttcgtgccgtccatcaaggccgggaacgacatcgccgcctgcctgcggaagaacggcaagaaggtcatccagctgagccgcaagaccttcgactccgagtacgtgaagacccggaccaacgactgggacttcgtggtcacgaccgacatcagcgagatgggcgcgaacttcaaggccgagcgcgtgatcgacccccggcgctgcatgaagcccgtgatcctcaccgacggggaggagcgggtcatcctggccggccccatgccggtgacccactccagcgccgcccagcgccgggggcgcatcggccggaaccccaagaacgagaacgaccagtacatctacatgggggagcccctggagaacgacgaggactgcgcgcactggaaggaggccaagatgctcctggacaacatcaacacgcccgagggcatcatcccgtccatgttcgagcccgagcgcgagaaggtggacgccatcgacggcgagtaccggctgcgcggggaggcccgcaagaccttcgtcgacctcatgcggcgcggcgacctgcccgtgtggctggcctaccgggtggcggccgaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctacagcgaccccctcgccctgaaggagttcaaggagttcgcggccggccggaagtccctgaccctcaacctgatcacggagatgggccgcctgcccaccttcatgacccagaaggcccgggacgccctcgacaacctggcggtcctgcacaccgccgaggccgggggccgcgcctacaaccacgccctcagcgagctgcccgagacgctggagaccctcctgctgctcaccctgctggcgaccgtgaccgggggcatcttcctcttcctgatgtccggccgggggatcggcaagatgaccctggggatgtgctgcatcatcaccgccagcatcctcctgtggtacgcccagatccagccgcactggatcgccgcctccatcatcctggagttcttcctcatcgtgctgctgatccccgagcccgagaagcagcgcacgccccaggacaaccagctcacctacgtcgtgatcgcgatcctgacggtggtcgccgccaccatggccaacgagatgggcttcctggagaagaccaagaaggacctcgggctgggcagcatcaccacgcagcagccggagagcaacatcctggacatcgacctccggcccgcctccgcgtggaccctgtacgccgtggccaccaccttcgtgacgcccatgctgcgccacagcatcgagaactccagcgtcaacgtgtccctcaccgccatcgccaaccaggcgaccgtgctgatgggcctggggaagggctggcccctcagcaagatggacatcggggtcccgctgctggccatcggctgctactcccaggtgaaccccatcaccctcacggccgccctgttcctgctcgtggcgcactacgccatcatcgggcccggcctgcaggccaaggccacccgggaggcccagaagcgcgcggccgccggcatcatgaagaaccccaccgtcgacgggatcaccgtgatcgacctggacccgatcccctacgaccccaagttcgagaagcagctcggccaggtgatgctgctggtcctctgcgtgacccaggtgctgatgatgcggaccacctgggccctgtgcgaggccctcaccctggcgacggggcccatcagcaccctgtgggagggcaacccggggcgcttctggaacaccaccatcgccgtctccatggccaacatcttccggggcagctacctcgccggcgccgggctgctgttctccatcatgaagaacacgaccaacacccgccgcggcaccgggaacatcggcgagacgctcggcgagaagtggaagtcccggctgaacgcgctgggcaagagcgagttccagatctacaagaagtccgggatccaggaggtggaccgcaccctcgccaaggaggggatcaagcggggcgagaccgaccaccacgccgtgtcccgcgggagcgccaagctgcggtggttcgtcgagcgcaacatggtgacccccgagggcaaggtggtcgacctgggctgcgggcggggcgggtggtcctactactgcggcgggctcaagaacgtgcgcgaggtgaagggcctgacgaagggcgggcccggccacgaggagcccatcccgatgagcacctacgggtggaacctggtccggctccagtccggcgtggacgtgttcttcacgccgcccgagaagtgcgacaccctgctgtgcgacatcggggagagcagccccaacccgacggtcgaggcgggccgcaccctccgggtgctgaacctggtggagaactggctcaacaacaacacccagttctgcatcaaggtcctgaacccctacatgccctccgtgatcgagaagatggaggccctgcagcgcaagtacggcggggccctcgtgcggaacccgctgagccgcaactccacccacgagatgtactgggtcagcaacgcctccggcaacatcgtgagctccgtgaacatgatcagccggatgctgatcaaccgcttcaccatgcggcacaagaaggccacgtacgagcccgacgtcgacctggggtccggcacccgcaacatcgggatcgagagcgagatccccaacctcgacatcatcggcaagcggatcgagaagatcaagcaggagcacgagacctcctggcactacgaccaggaccacccctacaagacctgggcgtaccacggcagctacgagacgaagcagaccgggtccgccagctccatggtgaacggcgtggtccgcctgctgaccaagccgtgggacgtggtgcccatggtcacccagatggccatgacggacaccacccccttcgggcagcagcgcgtgttcaaggagaaggtggacacccggacgcaggagcccaaggagggcaccaagaagctcatgaagatcaccgccgagtggctgtggaaggagctgggcaagaagaagaccccgcgcatgtgcacgcgggaggagttcacccgcaaggtccggagcaacgccgcgctcggggccatcttcaccgacgagaacaagtggaagtccgcccgcgaggccgtggaggacagccggttctgggagctggtcgacaaggagcgcaacctgcacctcgagggcaagtgcgagacctgcgtgtacaacatgatggggaagcgggagaagaagctgggcgagttcgggaaggccaagggctcccgcgcgatctggtacatgtggctgggcgcccggttcctcgagttcgaggccctggggttcctgaacgaggaccactggttcagccgcgagaacagcctctccggcgtggagggggagggcctgcacaagctggggtacatcctccgggacgtcagcaagaaggagggcggcgccatgtacgcggacgacacggccgggtgggacacccgcatcaccctggaggacctgaagaacgaggagatggtgaccaaccacatggagggcgagcacaagaagctcgccgaggccatcttcaagctgacgtaccagaacaaggtggtccgggtgcagcgccccacgccccgggggaccgtgatggacatcatctcccgccgggaccagcgcggcagcgggcaggtcggcacctacggcctgaacaccttcaccaacatggaggcccagctcatccggcagatggagggggagggcgtgttcaagtccatccagcacctgaccgtgaccgaggagatcgcggtccagaactggctggcccgcgtggggcgcgagcggctcagccgcatggccatctccggcgacgactgcgtggtcaagcccctggacgaccggttcgccagcgccctgacggcgctcaacgacatgggcaaggtgcgcaaggacatccagcagtgggagccgtcccgggggtggaacgactggacccaggtgcccttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcccagatgtggagcctcatgtacttccaccggcgcgacctgcggctggcggccaacgccatctgctccgccgtccccagccactgggtgccgacctcccgcacgacctggagcatccacgccaagcacgagtggatgaccaccgaggacatgctcaccgtgtggaaccgggtctggatccaggagaacccctggatggaggacaagacgcccgtggagagctgggaggagatcccctacctgggcaagcgcgaggaccagtggtgcgggtccctgatcggcctcaccagccgggcgacctgggccaagaacatccagaccgccatcaaccaggtgcgctccctgatcgggaacgaggagtacacggactacatgccgagcatgaagcggttccgccgcgaggaggaggaggccggcgtcctgtggtga

SEQ ID NO: 9316 - RNA, 9876 nt, synthetic construct
  misc_feature 1..9876: note = derived and/or modified CDS sequence (opt1) from DENV-2__KF360005__SS-prME
  source 1..9876: mol_type = other RNA
accgccggggtgatcatcatgcggatccccaccgccatggcgttccacctgaccacccggaacggggagccccacatgatcgtgagcaagcaggagaagggcaagtccctcctgttcaagaccgaggacggggtgaacatgtgcaccctgatggccatggacctcggcgagctgtgcgaggacaccatcacctacaactgccccctgctccggcagaacgagcccgaggacatcgactgctggtgcaacagcacctccacctgggtgacctacgggacctgcaccgccaccggcgagcaccggcgggagaagcggagcgtcgccctggtgccccacgtgggcatggggctggagacccgcaccgagacctggatgtccagcgagggcgcctggaagcacgcgcagcggatcgagacctggatcctccgccaccccgggttcaccatcatggccgccatcctggcctacaccatcggcaccacctacttccagcgggtcctgatcttcatcctcctgacggcggtggccccctccatgaccatgcgctgcatcgggatcagcaaccgggacttcgtggagggcgtctccggcgggagctgggtggacatcgtgctggagcacggctcctgcgtcaccaccatggccaagaacaagcccacgctcgacttcgagctgatcaagaccgaggccaagcagcccgccaccctgcgcaagtactgcatcgaggcgaagctcaccaacacgaccaccgccagccggtgcccgacccagggggagccctccctgaacgaggagcaggacaagcgcttcgtgtgcaagcacagcatggtgggccggggctggggcgacggctgcgggctgttcggcaagggcgggatcgtcacgtgcgccatgttcacgtgcaagaagaacatggaggggaagatcgtgcagcccgagaacctcgagtacaccatcgtggtcacgccccactccggggaggagaacgccgtgggcaacgacacggggaagcacggcaaggagatcaaggtgaccccgcagagctccatcaccgaggccgagctgaccgggtacggcaccgtcacgatggagtgcagcccccgcaccggcctggacttcaacgagatggtgctcctgcagatggagaacaaggcgtggctggtgcaccggcagtggttcctcgacctgcccctgccctggctcccgggggccgacatccagggctccaactggatccagaaggagaccctggtcaccttcaagaacccccacgccaagaagcaggacgtggtcgtgctggggagccaggagggcgccctccacacggccctgaccggggcgaccgagatccagatgagctccggcaacctgctgttcaccggccacctgaagtgccgcctgcggatggacaagctccagctgaaggggatgagctactccatgtgcacgggcaagttcaaggtggtcaaggagatcgccgagacccagcacgggaccatcgtggtgcgcatccagtacgagggcgacggcagcccctgcaagatccccttcgagatcatggacctggagaagcggcacgtcctcgggcgcctgatcaccgtgaacccgatcgtgacggagaaggactcccccgtcaacatcgaggccgagccgcccttcggcgacagctacatcatcatcggggtggagccgggccagctgaagctctcctggttcaagaaggggagctccatcggccagatgttcgagaccaccatgcgcggcgccaagcggatggccatcctgggggacaccgcgtgggacttcggcagcctcggcggggtgttcacgtccatcgggaaggccctccaccaggtcttcggggccatctacggcgccgcgttcagcggggtgtcctggaccatgaagatcctgatcggcgtggtcatcacctggatcgggatgaacagccgctccaccagcctgtccgtgagcctggtgctcgtcggcgtggtgacgctgtacctgggggtcatggtgcaggccgactccggctgcgtggtcagctggcggaacaaggagctcaagtgcggcagcgggatcttcatcaccgacaacgtgcacacctggaccgagcagtacaagttccagcccgagtcccccagcaagctggcctccgccatccagaaggcccacgaggagggcatctgcgggatccgcagcgtgacgcggctggagaacctcatgtggaagcagatcacccccgagctgaaccacatcctgtccgagaacgaggtcaagctcagcatcatgaccggcgacatcaaggggatcatgcaggcgggcaagcgctccctgcggccgcagcccaccgagctgaagtacagctggaagacgtggggcaaggccaagatgctctccaccgagccccacaaccagaccttcctgatcgacgggccggagaccgccgagtgccccaacacgaaccgcgcctggaacagcctggaggtggaggactacggcttcggggtgttcaccaccaacatctggctcaagctgaaggagcggcaggacgtcttctgcgactccaagctgatgagcgccgcgatcaaggacaaccgcgccgtgcacgccgacatgggctactggatcgagtccgccctcaacgacacctggaagatcgagaaggccagcttcatcgaggtgaagtcctgccactggcccaagagccacacgctgtggtccaacggcgtcctggagagcgagatgatcatccccaagaacttcgcggggccggtgagccagcacaactaccggcccggctaccacacccagaccgccgggccctggcacctcggcaagctggagatggacttcgacttctgcgaggggaccaccgtggtcgtgacggaggactgcggcaaccgcggcccctccctgcggaccaccaccgccagcgggaagctcatcacggagtggtgctgccgctcctgcaccctgccgcccctgcggtaccgcggcgaggacgggtgctggtacggcatggagatccggcccctcaaggagaaggaggagaacctggtgaacagcctggtcaccgccgggcacggccagatcgacaacttctccctcggcgtgctggggatggcgctgttcctcgaggagatgctgcgcacccgggtgggcacgaagcacgccgtcctgctcgtggccgtgagcttcatgaccctgatcaccgggaacatgtccttccgcgacctgggccgcgtcatggtgatggtgggggccgccatgaccgacgacatcggcatgggcgtcacgtacctcgcgctgctggccgccttcaaggtgcggcccaccttcgccgccgggctcctgctgcgcaagctcaccagcaaggagctgatgatgaccacgatcggcatcgtgctgctctcccagagcaccaccccggagaccatcctggagctgacggacgcgctcgccctggggatgatgatcctgaagatcgtccggaacatggagaagtaccagctcgccgtgaccatcatggccatcctgtgcgtccccaacgccgtgatcctgcagaacgcgtggaaggtgtcctgcaccatcctcgccgccgtcagcgtgagccccctgctgctcaccagctcccagcagaaggccgactggatccccctggcgctgacgatcaagggcctcaacccgaccgccatcttcctgaccaccctgagccgcacgaacaagaagcggtcctggcccctcaacgaggccatcatggccgtgggcatggtcagcatcctggcctccagcctgctcaagaacgacatccccatgaccgggcccctggtggcgggcgggctgctcaccgtgtgctacgtcctgaccggccgcagcgccgacctggagctcgagcgggccgccgacgtgcgctgggaggaccaggccgaggtgtccgggagctccccgatcctgagcatcacgatctccgaggacggcagcatgtccatcaagaacgaggaggaggagcagaccctgaccatcctcatccggaccggcctgctggtcatcagcggcctcttccccgtgtccatccccatcacggcggccgcctggtacctgtgggaggtgaagaagcagcgcgccggcgtcctgagcgccgtgccctccccgccgcccgtggggaaggcggagctcgaggacggcgcctaccggatcaagcagaaggggatcctgggctacagccagatcggcgccggggtctacaaggagggcaccttccacaccatgtggcacgtgacccgcggggccgtgctgatgcacaagggcaagcggatcgagccgtcctgggccgacgtccgcaaggacctcatcagctacgggggcggccggaagctggagggggagtggaaggagggcgaggaggtccaggtgctggcgctcgagcccgggaagaacccccgcgccgtccagaccaagcccggcctgttcaagacgaacaccgggaccatcggcgccgtgtccctggacttcagcccgggcgcctccgggagccccatcgtggacaagaagggcaaggtcgtggggctctacggcaacggcgtggtcacccggtccgggacgtacgtgagcgcgatcgcccagaccgagaagtccatcgaggacaaccccgagatcgaggacgacatcttccgcaagaagcggctgaccatcatggacctgcaccccggcgccgggaagaccaagcgctacctgccggccatcgtgcgggaggccatcaagcgcggcctccgcacgctgatcctggcgcccacccgggtcgtggccgccgagatggaggaggccctccgcgggctgcccatccggtaccagacccccgccatccgcgcggagcacaccggccgggagatcgtggacctgatgtgccacgccacgttcaccatgcgcctcctgtccccggtccgggtgcccaactacaacctgatcatcatggacgaggcccacttcaccgaccccgccagcatcgccgcgcgcggctacatctccacccgggtggagatgggggaggccgccggcatcttcatgacggccacgccgcccgggagccgcgaccccttcccccagtccaacgcgcccatcatggacgaggagcgggagatccccgagcgcagctggaactccggccacgagtgggtcaccgacttcaaggggaagaccgtgtggttcgtgcccagcatcaaggccggcaacgacatcgccgcctgcctccggaagaacggcaagaaggtcatccagctgtcccgcaagacgttcgacagcgagtacatcaagacccggaccaacgactgggacttcgtggtgaccacggacatctccgagatgggggccaacttcaaggcggagcgcgtcatcgacccccggcgctgcatgaagcccgtgatcctgaccgacggcgaggagcgggtgatcctcgccgggccgatgcccgtcacccacagctccgccgcccagcgccgcggccggatcgggcgcaaccccaagaacgagaacgaccagtacatctacatgggcgagcccctggagaacgacgaggactgcgcccactggaaggaggcgaagatgctgctcgacaacatcaacaccccggagggcatcatccccagcatgttcgagcccgagcgggagaaggtggacgccatcgacggggagtaccgcctgcggggcgaggcccgcaagacgttcgtggacctgatgcggcgcggggacctcccggtctggctggcctaccgggtggccgcggagggcatcaactacgccgaccgccggtggtgcttcgacgggatcaagaacaaccagatcctggaggagaacgtcgaggtggagatctggaccaaggagggcgagcgcaagaagctcaagccccggtggctggacgcccgcatctactccgaccccctggccctcaaggagttcaaggagttcgcggccggccgcaagagcctgaccctgaacctcatcaccgagatggggcgcctgcccacgttcatgacccagaaggcccggaacgccctggacaacctcgccgtgctgcacaccgcggaggccggcgggcgcgcctacaaccacgccctgtccgagctcccggagaccctggagacgctgctcctgctgaccctcctggccaccgtcaccggcggcatcttcctgttcctcatgagcgggaagggcatcgggaagatgacgctgggcatgtgctgcatcatcaccgcgtccatcctgctctggtacgcccagatccagccccactggatcgccgccagcatcatcctggagttcttcctgatcgtgctcctgatccccgagcccgagaagcagcggaccccgcaggacaaccagctgacctacgtggtcatcgccatcctcaccgtggtggcggccacgatggccaacgagatggggttcctggagaagaccaagaaggacttcggcctgggcagcatcgccacccagcagcccgagtccaacatcctcgacatcgacctgcgccccgccagcgcgtggaccctgtacgccgtcgccacgaccttcatcacccccatgctccggcactccatcgagaacagctccgtgaacgtgagcctgaccgccatcgcgaaccaggccacggtcctgatggggctcggcaaggggtggccgctgtccaagatggacatcggcgtgcccctgctcgccatcgggtgctacagccaggtgaaccccatcaccctgaccgccgccctgctcctgctggtcgcgcactacgccatcatcggccccggcctccaggccaaggccacccgcgaggcccagaagcgcgcggccgccgggatcatgaagaacccgacggccgacggcatcaccgtgatcgacctggaccccatcccctacgaccccaagttcgagaagcagctgggccaggtgatgctcctggtcctgtgcgtgacccaggtgctcatgatgcggaccacgtgggccctgtgcgaggcgctgaccctcgccaccggcccgatctccaccctgtgggaggggagccccggccgcttctggaacacgaccatcgccgtctccatggccaacatcttccggggcagctacctggcgggggccggcctcctgttctccatcatgaagaacaccaccaacacgcgccgggggaccggcaacaccggcgagaccctgggggagaagtggaagaaccgcctcaacagcctgggcaagtccgagttccagatctacaagcggagcgggatccaggaggtggaccgcacgctggccaaggagggcatcaagcgcggggagaccgaccaccacgccgtgtcccgcggcagcgccaagctccggtggttcgtcgagcgcaacctggtgacccccgagggcaaggtggtcgacctggggtgcggccgcggcgggtggtcctactactgcggcgggctcaagaacgtgcgcgaggtgcgggggctgaccaagggcgggcccgggcacgaggagccgatccccatgagcacgtacggctggaacctggtccgcctccagagcggggtggacgtgttcttcacgccgcccgagaagtgcgacaccctgctgtgcgacatcggcgagtccagcccgaaccccaccgtcgaggcgggccggacgctccgcgtgctgaacctggtggagaactggctcaacaacaacacccagttctgcatcaaggtcctgaacccctacatgccgtccgtgatcgagaagatggagaccctgcagcggaagtacgggggcgccctggtgcgcaaccccctcagccgcaactccacccacgagatgtactgggtcagcaacgcctccgggaacatcgtgagctccgtgaacatgatcagccggatgctgatcaaccgcttcaccatgcggcacaagaaggccacgtacgagcccgacgtcgacctgggctccgggacccgcaacatcggcatcgagagcgagacccccaacctcgacatcatcggcaagcggatcgagaagatcaagcaggagcacgagacctcctggcactacgaccaggaccacccgtacaagacgtgggcctaccacgggagctacgagaccaagcagaccggctccgcgagctccgtggtgaacggggtcgtgcgcctgctgaccaagccctgggacgtgatccccatggtcacgcagatggccatgaccgacaccacccccttcggccagcagcgggtgttcaaggagaaggtggacacgcgcacccaggagccgaaggagggcaccaagaagctcatgaagatcaccgccgagtggctgtggaaggagctggggaagaagaagacgccccggatgtgcacccgcgaggagttcgcccggaaggtccgcagcaacgccgcgctcggcgccatcttcaccgacgagaacaagtggaagtccgcccgggaggccgtggaggacagccgcttctgggagctggtcgacaaggagcggaacctgcacctcgaggggaagtgcgagacctgcgtgtacaacatgatgggcaagcgcgagaagaagatcggggagttcggcaaggcgaagggcagccgggccgtgtggtacatgtggctgggggcccgcttcctggagttcgaggccctcggcttcctgaacgaggaccactggttctcccgggagaacagcctgtccggggtcgagggcgaggggctccacaagctgggctacatcctgcgcgaggtgagcaagaaggagggcggggccatgtacgcggacgacacggccggctgggacacccggatcaccctcgaggacctgaagaacgaggagatggtgaccaaccacatggagggggagcacaagaagctggccgaggccatcttcaagctcacgtaccagaacaaggtcgtgcgcgtgcagcgccccacgccccggggcaccgtcatggacatcatctcccgccgggaccagcgcagctccggccaggtgggcacctacggcctgaacacgttcaccaacatgggggcccagctgatccggcagatggagggcgagggggtgttcaagggcatccagcacctcaccgcgaccgaggaggtcgccgtgcaggactggctggcccgcgtgggccgggagcgcctgagccggatggccatctccggggacgactgcgtcgtgaagccgctcgacgaccgcttcgccagcgcgctgacggccctgaacgacatgggcaaggtgcggaaggacatccagcagtgggagccctcccgcgggtggaacgactggacccaggtccccttctgcagccaccacttccacgagctcatcatgaaggacggccgggtgctggtggtcccctgccgcaaccaggacgagctgatcgggcgggcccgcatctcccagggcgccggctggagcctccgggagaccgcctgcctggggaagtcctacgcgcagatgtggagcctgatgtacttccaccgccggggcctccgcctggccgccaacgccatctgctccgcggtgccgagccactgggtgcccaccagccgcacgacctggtccatccacgcccggcacgagtggatgaccaccgaggacatgctgaccgtctggaaccgcgtgtggatccaggagaacccctggatggaggacaagacgcccgtggagagctgggaggagatcccgtacctcgggaagcggggcgaccagtggtgcgggtccctgatcggcctgaccagccgcgccacctgggcccggaacatccagaccgccatcaaccgcgtccggtccctcatcggcagcgaggggtacacggactacatgccctccatgaagcgcttccggcgcgaggaggacgaggcgggcgtgctgtggtga

SEQ ID NO: 9317 - RNA, 9876 nt, synthetic construct
  misc_feature 1..9876: note = derived and/or modified CDS sequence (opt1) from DENV-2__KJ010185__SS-prME
  source 1..9876: mol_type = other RNA
accgcgggcgtgatcatcatgctgatccccaccgccatggcgttccacctcaccacccgcaacggggagccccacatgatcgtcagcaagcaggagaagggcaagtccctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacgccacctccacctgggtgacctacgggacctgcaccgccaccggcgagcaccgccgggagaagcgctccgtcgccctggtgccccacgtgggcatggggctcgagacccggaccgagacctggatgagctccgagggcgcgtggaagcacgcccagcgcatcgagacctggatcctgcggcacccggggttcacgatcatggccgccatcctggcgtacaccatcggcaccacctacttccagcgcgtcctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggccaagaacaagcccacgctggacttcgagctgatcaagaccgaggccaagcagcccgcgaccctccggaagtactgcatcgaggccaagctgaccaacacgaccaccgcctcccgctgcccgacccagggggagcccagcctgaacgaggagcaggacaagcggttcgtgtgcaagcactccatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagaacgccgtggggaacgacacgggcaagcacgggaaggagatcaaggtgaccccgcagtccagcatcaccgaggcggagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacatccaggggagcaactggatccagaaggagaccctggtcaccttcaagaacccccacgccaagaagcaggacgtggtcgtgctcggctcccaggagggggccatgcacacggcgctgaccggcgccaccgagatccagatgagcagcgggaaccccctgttcaccggccacctcaagtgccggctgcgcatggacaagctgcagctcaagggcatgtcctacagcatgtgcacggggaagttcaaggtggtcaaggagatcgccgagacccagcacggcaccatcgtggtgcggatccagtacgagggggacggctccccctgcaagatcccgttcgagatcatggacctggagaagcgccacgtcctgggccggctcatcaccgtgaaccccatcgtgacggagaaggacagccccgtcaacatcgaggccgagcccccgttcggggactcctacatcatcatcggcgtggagcccgggcagctgaagctgagctggttcaagaagggctccagcatcgggcagatgttcgagaccaccatgcgcggcgccaagcgcatggcgatcctcggcgacaccgcctgggacttcgggtccctgggcggggtgttcacgagcatcggcaaggccctgcaccaggtcttcggggccatctacggcgcggccttctccggcgtgagctggaccatgaagatcctcatcggggtggtcatcacctggatcggcatgaactcccggagcacctccctgagcgtgtccctggtgctggtcggggtggtgacgctctacctgggcgtcatggtgcaggccgacagcgggtgcgtggtctcctggaagaacaaggagctgaagtgcggcagcggcatcttcttcaccgacaacgtgcacacctggaccgagcagtacaagttccagcccgagagcccctccaagctcgccagcgccatccagaaggcgcacgaggaggggatctgcggcatccgctccatcacgcggctggacaacctgatgtggaagcagatcaccccggagctcaaccacatcctgagcgagaacgaggtgaagctgtccatcatgaccggggacatcaagggcatcatgcaggccgggaagcgcagcctccggccccagcccaccgagctgaagtactcctggaagacgtggggcaaggccaagatgctgagcaccgagccgcacaaccagaccttcctcatcgacggccccgagaccgcccagtgccccaacacgaaccgcgcctggaactccctggaggtcgaggactacgggttcggcgtgttcaccaccaacatctggctgaagctcaaggagcggcaggacgtgttctgcgacagcaagctgatgtccgcggccatcaaggacaaccgcgccgtccacgccgacatggggtactggatcgagagcgccctgaacgacacctggaagatcgagaaggcgtccttcatcgaggtcaagagctgccactggcccaagtcccacacgctctggagcaacggcgtgctggagtccgagatgatcatcccgaagaacttcgccggccccgtgagccagcacaactaccggcccgggtaccacacccagaccgccggcccctggcacctggggaagctcgagatggacttcgacttctgcgagggcaccaccgtggtggtcacggaggactgcgggaaccgcggcccgagcctgcggaccaccaccgcctccggcaagctgatcacggagtggtgctgccgcagctgcaccctgccgcccctccggtaccgcggggaggacggctgctggtacgggatggagatccggcccctgaaggagaaggaggagaacctcgtgaactccctggtgaccgcgggccacgggcagatcgacaacttcagcctgggcgtcctcggcatggccctgttcctggaggagatgctccgcacccgggtggggacgaagcacgccgtgctgctggtcgccgtgtccttcatgaccctcatcaccggcaacatgagcttccgcgacctggggcgggtgatggtcatggtgggcgccgcgatgaccgacgacatcgggatgggcgtgacgtacctggccctcctggccgccttcaaggtccgcccgaccttcgccgcgggcctgctcctgcgcaagctgacctccaaggagctcatgatgaccacgatcgggatcgtgctgctgagccagtccaccacccccgagaccatcctcgagctgacggacgccctggccctcggcatgatgatcctgaagatcgtgcggaacatggagaagtaccagctggccgtcaccatcatggccatcctctgcgtgcccaacgcggtcatcctgcagaacgcctggaaggtgagctgcaccatcctggccgccgtgtccgtcagccccctcctgctgacctccagccagcagaaggcggactggatcccgctcgccctgacgatcaaggggctgaaccccaccgccatcttcctcaccaccctgtcccgcacgaacaagaagcggagctggcccctgaacgaggccatcatggccgtgggcatggtgtccatcctcgcgagctccctgctgaagaacgacatccccatgaccggcccgctcgtcgccgggggcctgctgaccgtgtgctacgtgctcaccgggcgcagcgccgacctggagctggagcgggccgccgacgtccgctgggaggaccaggcggagatcagcggctccagccccatcctctccatcacgatcagcgaggacgggtccatgagcatcaagaacgaggaggaggagcagaccctgaccatcctgatccggaccggcctcctggtgatctccggcctgttccccgtgagcatccccatcacggccgccgcctggtacctctgggaggtcaagaagcagcgcgccggggtgctgtgggacgtgccgagcccgccgcccgtcggcaaggcggagctggaggacggggcctaccggatcaagcagaagggcatcctcgggtacagccagatcggcgccggcgtgtacaaggaggggaccttccacaccatgtggcacgtgacccgcggcgccgtcctgatgcacaaggggaagcggatcgagccctcctgggccgacgtgcgcaaggacctgatcagctacggcgggggctggaagctcgagggcgagtggaaggagggggaggaggtgcaggtcctggcgctggagcccggcaagaacccccgggccgtgcagaccaagcccggcctgttcaagacgaacaccggcaccatcggggccgtgtccctggacttcagccccggcacctccggcagccccatcgtcgacaagaaggggaaggtggtgggcctgtacgggaacggcgtcgtgacgcgctccggcacctacgtgagcgccatcgcgcagaccgagaagtccatcgaggacaaccccgagatcgaggacgacatcttccggaagaagcgcctcaccatcatggacctgcacccgggggccggcaagacgaagcggtacctgcccgccatcgtccgcgaggccatcaagcgggggctgcgcaccctcatcctggcccccacccgggtggtggcggccgagatggaggaggccctgcgcggcctccccatccgctaccagaccccggccatccgggccgagcacacggggcgcgagatcgtcgacctgatgtgccacgcgaccttcaccatgcggctgctcagccccgtgcgcgtgcccaactacaacctgatcatcatggacgaggcccacttcaccgaccccgccagcatcgccgcccggggctacatctccacgcgcgtcgagatgggcgaggcggccgggatcttcatgaccgccaccccgcccggcagccgggaccccttcccccagtccaacgccccgatcatggacgaggagcgcgagatccccgagcggagctggaactccgggcacgagtgggtgaccgacttcaagggcaagacggtgtggttcgtccccagcatcaaggcggggaacgacatcgccgcctgcctgcgcaagaacggcaagaaggtgatccagctctcccggaagaccttcgacagcgagtacatcaagacccgcaccaacgactgggacttcgtggtcacgaccgacatctccgagatgggcgccaacttcaaggccgagcgggtgatcgacccccgccggtgcatgaagccggtgatcctgaccgacggggaggagcgcgtcatcctggcgggccccatgcccgtgacccacagctccgccgcccagcggcgcgggcggatcggccgcaaccccaagaacgagaacgaccagtacatctacatgggggagccgctcgagaacgacgaggactgcgcccactggaaggaggccaagatgctgctggacaacatcaacacgcccgagggcatcatccccagcatgttcgagccggagcgcgagaaggtggacgcgatcgacggcgagtaccggctccgcggggaggcccggaagaccttcgtcgacctgatgcgccggggcgacctgcccgtgtggctcgcctaccgcgtggccgccgaggggatcaactacgcggaccggcgctggtgcttcgacggcatcaagaacaaccagatcctggaggagaacgtcgaggtggagatctggaccaaggagggggagcggaagaagctgaagccccgctggctcgacgcccggatctactccgaccccctggccctgaaggagttcaaggagttcgccgcgggccgcaagagcctcaccctgaacctgatcacggagatgggccggctcccgaccttcatgacccagaaggcccgcaacgccctggacaacctggccgtcctccacaccgccgaggccggcgggcgggcctacaaccacgccctgtccgagctgcccgagacgctcgagaccctgctgctcctgaccctgctcgccaccgtgaccggcgggatcttcctgttcctgatgagcgggaaggggatcggcaagatgaccctcgggatgtgctgcatcatcaccgcctccatcctgctgtggtacgcgcagatccagccccactggatcgccgccagcatcatcctcgagttcttcctgatcgtgctgctcatccccgagccggagaagcagcgcacgccccaggacaaccagctgacctacgtcgtgatcgccatcctgacggtggtcgccgcgaccatggccaacgagatgggcttcctcgagaagaccaagaaggacttcgggctgggctccatcgccacccagcagcccgagagcaacatcctggacatcgacctccggcccgccagcgcctggacgctgtacgcggtggccaccaccttcatcaccccgatgctgcgccactccatcgagaacagctccgtgaacgtcagcctcacggccatcgccaaccaggcgaccgtgctgatgggcctggggaagggctggcccctctccaagatggacatcggggtgcccctgctggccatcggctgctacagccaggtcaaccccatcaccctcaccgccgccctgctgctcctggtggcccactacgcgatcatcgggccgggcctgcaggccaaggcctcccgggaggcccagaagcgcgccgcggccggcatcatgaagaaccccacggtggacgggatcaccgtcatcgacctcgaccccatcccctacgacccgaagttcgagaagcagctgggccaggtgatgctgctcatcctgtgcgtgacccaggtcctgatgatgcggaccacgtgggccctctgcgaggccctgaccctggccaccgggcccatcagcaccctctgggagggcaaccccgggcgcttctggaacacgaccatcgcggtgtccatggccaacatcttccgcggcagctacctggccggcgccgggctcctcttctccatcatgaagaacaccaccaacacgcggcgcggcaccgggaacaccggcgagaccctgggcgagaagtggaagaaccgggtgagcctgctcgggaagtccgagttccagatctacaagcgcagcggcatccaggaggtcgaccggacgctggcgaaggaggggatcaagcgcggcgagaccgaccaccacgccgtgtcccgggggagcgccaagctgcgctggttcgtggagcggaacctcgtcacccccgagggcaaggtggtggacctgggctgcgggcgcggcgggtggtcctactactgcggcgggctgaagaacgtccgggaggtgaagggcctcaccaagggcgggccgggccacgaggagcccatccccatgagcacgtacgggtggaacctggtgcgcctgctcaccggcgccgacgtcttcttcacgcccccggagaagtgcgacaccctgctgtgcgacatcggggagtccagccccaaccccacggtggaggccggccggaccctccgcgtgctgaacctggtcgagaactggctcaacaacaacacccagttctgcatcaaggtgctgaacccgtacatgcccagcgtgatcgagaagatggagaccctgcagcggaagtacggcggggcgctggtccgcaaccccctctcccggaacagcacccacgagatgtactgggtgtccaacgccagcggcaacatcgtgtccagcgtcaacatgatctcccgcatgctgatcaaccggttcacgatgcgccacaagaaggccacctacgaccccgacgtggacctggggagcggcacccgcaacatcgggatcgagtccgagaccccgaacctcgacatcatcggcaagcggatcgagaagatcaagcaggagcacgagacgagccgccactacgaccaggaccacccctacaagacctgggcctaccacggctcctacgagaccaagcagaccgggagcgcctccagcacggtgaacggcgtcgtgcggctgctgaccaagccctgggacgtgatccccatggtcacccagatggcgatgaccgacacgaccccgttcgggcagcagcgcgtgttcaaggagaaggtggacacccggacccaggagcccaaggagggcacgaagaagctcatgaagatcaccgccgagtggctgtggaaggagctgggcaagaagaagacgccccgcatgtgcacccgggaggagttcgcccgcaaggtccggtccaacgccgccctcggggcgatcttcacggacgagaacaagtggaagtccgcccgcgaggccgtggaggactcccggttctgggagctggtggacaaggagcgcaacctgcacctcgagggcaagtgcgagacctgcgtctacaacatgatggggaagcgggagaagaagatcggcgagttcgggaaggccaagggcagccgcgcgatctggtacatgtggctgggcgcccggttcctggagttcgaggccctcgggttcctgaacgaggaccactggttctcccgcgagaacagcctgagcggcgtggagggggagggcctccacaagctggggtacatcctgcgggaggtctccaagaaggagggcggcgccatgtacgccgacgacaccgcggggtgggacacccgcatcacgctcgaggacctgaagaacgaggagatggtgaccaaccacatggagggcgagcacaagaagctggccgaggccatcttcaagctcacctaccagaacaaggtggtccgggtgcagcgccccaccccgcgggggacggtgatggacatcatcagccgccgcgaccagcggggctccgtccaggtggggacctacggcctgggcaccttcaccaacatgggggcccagctgatccgccagatggagggcgagggggtgttcaagggcatccagcacctcacggccaccgaggaggtcgcggtgcaggactggctggcccgggtgggccgcgagcggctgagccgcatggccatctccggggacgactgcgtcgtgaagcccctcgacgaccggttcgccagcgccctgaccgcgctgaacgacatgggcaaggtgcgcaaggacatccagcagtgggagccctcccgggggtggaacgactggacccaggtccccttctgcagccaccacttccacgagctcatcatgaaggacggccgcgtgctggtggtcccgtgccggaaccaggacgagctgatcgggcgcgcccggatctcccagggcgccggctggagcctccgcgagacggcctgcctggggaagtcctacgcccagatgtggagcctgatgtacttccaccggcgcgacctccggctggcggccaacgccatctgctccgccgtgcccagccactgggtgcccacctcccgcaccacctggagcatccacgcgggccacgagtggatgaccacggaggacatgctgaccgtctggaaccgggtgtggatccaggagaacccctggatggaggacaagaccccggtggagtcctgggaggagatcccctacctcgggaagcgcgaggaccagtggtgcggcagcctgatcgggctgaccagccgcgccacgtgggcccggaacatccagaccgccatcaaccaggtccgctccctcatcggcagcgaggagtacaccgactacatgccctccatgaagcggttcggccgcgaggaggaggaggccggggtgctgtggtga

SEQ ID NO: 9318 - RNA, 9876 nt, synthetic construct
  misc_feature 1..9876: note = derived and/or modified CDS sequence (opt1) from DENV-2__KJ010186__SS-prME
  source 1..9876: mol_type = other RNA
accgccggcgtgatcatcatgctgatccccaccgccatggcgttccacctcaccacccgcaacggggagccgcacatgatcgtgtccaagcaggagaagggcaagtccctgctgttcaagaccgaggacggggtgaacatgtgcaccctcatggccatggacctgggcgagctgtgcgaggacaccatcacctacaactgccccctcctgcggcagaacgagcccgaggacatcgactgctggtgcaacgccaccagcacctgggtgacctacgggacctgcaccgccaccggcgagcaccgccgggagaagcgctccgtcgccctggtgccccacgtgggcatggggctcgagacccggaccgagacctggatgagctccgagggcgcgtggaagcacgcccagcgcatcgagacctggatcctgcggcaccccgggttcaccatcatggccgccatcctggcgtacaccatcggcaccacctacttccagcgcgtcctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggccaagaacaagcccacgctggacttcgagctgatcaagaccgaggccaagcagcccgcgaccctccggaagtactgcatcgaggcccgcctgaccaacacgaccaccgcctcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagaacgccgtggggaacgacacgggcaagcacgggaaggagatcaaggtgaccccgcagtccagcatcaccgaggcggagctgaccggctacgggaccgtcacgatggagtgcagcccccggaccggcctcgacttcaacgagatggtgctgctgcagatggagaacaaggcctggctcgtgcaccggcagtggttcctggacctgcccctcccctggctgccgggcgccgacatccaggggagcaactggatccagaaggagaccctggtcaccttcaagaagccccacgccaagaagcaggacgtggtcgtgctcggctcccaggagggggccatgcacacggcgctgaccggcgccaccgagatccagatgagcagcgggaacctcctgttcaccggccacctgaagtgccgcctgcggatggacaagctccagctgaagggcatgtcctacagcatgtgcacggggaagttcaaggtggtcaaggagatcgccgagacccagcacggcaccatcgtggtgcgcgtccagtacgagggggacggctccccctgcaagatccccttcgagatcatggacctggagaagcggcacgtgctcggccgcctgatcaccgtgaacccgatcgtcacggagaaggacagccccgtgaacatcgaggccgagccgcccttcggggactcctacatcatcatcggcgtggagccggggcagctgaagctcagctggttcaagaagggctccagcatcgggcagatgttcgagaccaccatgcgcggcgccaagcggatggcgatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcgtgatcacctggatcggcatgaactcccgcagcacctccctgagcgtgtccctggtcctcgtgggggtggtcacgctgtacctgggcgtgatggtgcaggccgacagcgggtgcgtcgtgtcctggaagaacaccgccctcaagtgcggcagcggcatcttcatcaccgacaacgtgcacacctggacggagcagtacaagttccagcccgagagcccctccaagctggccagcgcgatccagaaggcccacgaggaggggatctgcggcatccggtccgtcacccgcctggagaacctcatgtggaagcagatcacccccgagctgaaccacatcctgagcgagaacgaggtgaagctctccatcatgaccggggacatcaagggcatcctgcaggccgggaagcggagcctgcgcccgcagcccacggagctcaagtactcctggaagacctggggcaaggccaagatgctgagcaccgagtcccacaaccagaccttcctgatcgacggccccgagacggccgagtgcccgaacaccaaccgggcgtggaacagcctcgaggtggaggactacgggttcggcgtcttcaccaccaacatctggctgaagctgaaggagcgccaggacgtgttctgcgactccaagctcatgagcgccgccatcaaggacaaccgggccgtgcacgccgacatggggtactggatcgagtccgcgctgaacgacacgtggaagatcgagaaggccagcttcatcgaggtcaagtcctgccactggcccaagagccacaccctgtggtccaacggcgtgctcgagagcgagatgatcatccccaagaacttcgccggccccgtgagccagcacaactaccgcccggggtaccacacccagaccgccggcccctggcacctggggaagctggagatggacttcgacttctgcgagggcaccacggtcgtggtgaccgaggactgcgggaaccggggcccctccctccgcaccaccacggcgagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgaccgccggccacgggcagatcgacaacttctccctgggcgtgctgggcatggccctcttcctggaggagatgctgcggacgcgcgtcgggaccaagcacgccgtgctcctggtggccgtcagcttcatgaccctgatcaccggcaacatgtccttccgggacctcgggcgcgtgatggtgatggtcggcgcggccatgacggacgacatcgggatgggcgtgacctacctggccctgctcgccgccttcaaggtgcgccccaccttcgcggccggcctgctgctccggaagctgaccagcaaggagctgatgatgacgaccatcgggatcgtcctcctgtcccagagcaccacccccgagacgatcctggagctcaccgacgccctggccctgggcatgatgatcctcaagatcgtgcgcaacatggagaagtaccagctggccgtcaccatcatggcgatcctgtgcgtgccgaacgccgtgatcctccagaacgcctggaaggtctcctgcaccatcctggccgcggtgagcgtgagccccctgctcctgacgagctcccagcagaaggccgactggatccccctggccctcaccatcaaggggctgaaccccaccgccatcttcctgaccacgctcagccggaccaacaagaagcgctcctggccgctgaacgaggccatcatggcggtcggcatggtgagcatcctggcctccagcctcctgaagaacgacatccccatgaccggccccctggtggccgggggcctcctgaccgtctgctacgtgctgacggggcggagcgccgacctcgagctggagcgcgccgcggacgtgcggtgggaggaccaggccgagatctccggcagctcccccatcctgagcatcaccatctccgaggacgggagcatgtccatcaagaacgaggaggaggagcagaccctcaccatcctgatccgcacgggcctgctcgtcatcagcggcctgttcccggtgtccatccccatcaccgccgccgcctggtacctgtgggaggtgaagaagcagcgggcgggggtcctctgggacgtgcgcagctacccgcccgtgggcaaggccgagctggaggacggggcctaccggatcaagcagaagggcatcctggggtactcccagatcggcgccggcgtctacaaggaggggaccttccacaccatgtggcacgtgacccgcggcgccgtgctcatgcacaaggggaagcggatcgagccgagctgggcggacgtccgcaaggacctgatctcctacggcgggggctggaagctggagggcgagtggaaggagggggaggaggtccaggtgctcgccctggagcccggcaagaacccccgggccgtccagacgaagccggggctgttcaagaccaacaccggcaccatcggggccgtgagcctcgacttctcccccggcacgagcggctcccccatcgtggacaagaaggggaaggtcgtgggcctgtacgggaacggcgtggtcacccgcagcggcacctacgtgtccgcgatcgcccagaccgagaagtccatcgaggacaaccccgagatcgaggacgacatcttccggaagaagcgcctgacgatcatggacctgcacccgggggccggcaagaccaagcggtacctccccgccatcgtgcgcgaggccatcaagcgggggctgcgcaccctgatcctcgcgcccacccgcgtcgtggccgccgagatggaggaggccctgcggggcctgcccatccgctaccagacgccggccatccgggcggagcacaccgggcgcgagatcgtggacctcatgtgccacgccaccttcaccatgcggctgctgagccccgtccgcgtgcccaactacaacctcatcatcatggacgaggcccacttcacggaccccgcctccatcgccgcgcggggctacatcagcacccgcgtggagatgggcgaggccgccgggatcttcatgaccgccaccccgcccggctcccgggaccccttcccccagagcaacgcgccgatcatggacgaggagcgcgagatccccgagcggtcctggaacagcgggcacgagtgggtcacggacttcaagggcaagaccgtgtggttcgtgccctccatcaaggccgggaacgacatcgccgcctgcctgcgcaagaacggcaagaaggtcatccagctgagccggaagaccttcgactccgagtacatcaagacccgcacgaacgactgggacttcgtggtgaccaccgacatcagcgagatgggcgccaacttcaaggcggagcgggtcatcgacccccgccggtgcatgaagccggtgatcctcaccgacggggaggagcgcgtgatcctggccggccccatgcccgtcacgcactccagcgccgcccagcggcgcgggcgcatcggccggaaccccaagaacgagaacgaccagtacatctacatgggggagccgctggagaacgacgaggactgcgcccactggaaggaggcgaagatgctcctggacaacatcaacacccccgagggcatcatcccctccatgttcgagcccgagcgcgagaaggtggacgccatcgacggcgagtaccggctgcgcggggaggcccggaagaccttcgtggacctcatgcgccggggcgacctgccggtctggctggcctaccgcgtggccgcggaggggatcaactacgccgaccggcgctggtgcttcgacggcatcaagaacaaccagatcctcgaggagaacgtcgaggtggagatctggaccaaggagggggagcggaagaagctgaagccccgctggctggacgcccggatctacagcgaccccctcgccctgaaggagttcaaggagttcgcggccggccgcaagtccctgacgctcaacctgatcaccgagatgggccggctgccgaccttcatgacccagaaggcccgcaacgccctcgacaacctggccgtgctgcacacggcggaggccgggggccgggcctacaaccacgccctcagcgagctgcccgagaccctggagaccctcctgctgctcaccctgctggccacggtcaccgggggcatcttcctcttcctgatgtccggcaaggggatcggcaagatgaccctggggatgtgctgcatcatcaccgcgagcatcctcctgtggtacgcccagatccagccccactggatcgccgcctccatcatcctggagttcttcctcatcgtgctgctgatccccgagccggagaagcagcgcacgccccaggacaaccagctcacgtacgtggtcatcgccatcctgaccgtggtggcggccaccatggccaacgagatgggcttcctggagaagaccaagaaggacttcgggctcggcagcatcgccacgcagcagcccgagagcaacatcctggacatcgacctgcggcccgcctccgcgtggaccctctacgccgtcgccaccaccttcatcacgccgatgctgcgccacagcatcgagaactccagcgtgaacgtgtccctgaccgccatcgcgaaccaggccaccgtcctcatgggcctggggaagggctggcccctgagcaagatggacatcggggtgcccctcctggccatcggctgctactcccaggtgaaccccatcaccctgacggccgccctcctgctgctcgtcgcgcactacgccatcatcgggccgggcctgcaggccaaggccacccgggaggcccagaagcgcgcggccgccggcatcatgaagaaccccaccgtggacgggatcaccgtgatcgacctggaccccatcccctacgacccgaagttcgagaagcagctcggccaggtcatgctgctggtgctctgcgtgacgcaggtcctgatgatgcgcaccacctgggccctgtgcgaggccctcaccctggcgacggggcccatcagcaccctgtgggagggcaaccccgggcggttctggaacaccaccatcgccgtgtccatggccaacatcttccgcggcagctacctcgccggcgcggggctgctgttctccatcatgaagaacacgaccaacacccggcgcggcaccgggaacacgggcgagaccctcggcgagaagtggaagaaccggctgaacagcctggggaagtccgagttccagatctacaagcgcagcggcatccaggaggtggaccggaccctcgccaaggaggggatcaagcgcggcgagaccgaccaccacgccgtctcccgggggagcgccaagctgcgctggttcgtggagcggaacctggtgacgcccgagggcaaggtcgtggacctcggctgcgggcgcggcgggtggtcctactactgcggcgggctgaagaacgtgcgggaggtcaagggcctgaccaagggcgggccgggccacgaggagcccatccccatgagcacctacgggtggaacctcgtgcgcctgcagtccggcgtggacgtcttcttcacgccgcccgagaagtgcgacacgctgctctgcgacatcggggagagcagccccaaccccaccgtggaggccggccggaccctgcgcgtgctgaacctcgtcgagaactggctgaacaacaacacccagttctgcatcaaggtgctgaacccctacatgccctccgtgatcgagaagatggagaccctgcagcggaagtacggcggggcgctcgtccgcaaccccctgagccggaactccacgcacgagatgtactgggtgagcaacgcctccggcaacatcgtgagctccgtcaacatgatcagccgcatgctgatcaaccgcttcaccatgcggcacaagaaggccacctacgagcccgacgtggacctcgggtccggcacccgcaacatcgggatcgagagcgagacgccgaacctggacatcatcggcaagcggatcgagaagatcaagcaggagcacgagacctcctggcactacgaccaggaccacccctacaagacctgggcctaccacggcagctacgagaccaagcagacggggtccgccagctccatggtgaacggcgtcgtgcgcctgctcaccaagccctgggacgtgatccccatggtcacccagatggcgatgaccgacacgaccccgttcgggcagcagcgggtgttcaaggagaaggtggacacccgcacccaggagcccaaggagggcacgaagaagctgatgaagatcaccgccgagtggctgtggaaggagctcggcaagaagaagacgccccggatgtgcacccgcgaggagttcgcccggaaggtccgcagcaacgccgccctgggggcgatcttcacggacgagaacaagtggaagtccgcccgggaggccgtggaggacagccgcttctgggagctggtcgacaaggagcggaacctccacctggagggcaagtgcgagacctgcgtgtacaacatgatggggaagcgcgagaagaagatcggcgagttcgggaaggccaagggctcccgggcgatctggtacatgtggctgggcgcccgcttcctcgagttcgaggccctggggttcctgaacgaggaccactggttcagccgggagaacagcctctccggcgtggagggggagggcctgcacaagctggggtacatcctccgcgaggtcagcaagaaggagggcggcgccatgtacgccgacgacaccgcggggtgggacacccggatcacgctggaggacctgaagaacgaggagatggtgaccaaccacatggagggcgagcacaagaagctcgccgaggccatcttcaagctgacctaccagaacaaggtggtccgcgtgcagcggcccaccccgcgcgggacggtgatggacatcatctcccgccgggaccagcgcggcagcgggcaggtcggcacctacggcctgaacaccttcaccaacatgggggcccagctcatccggcagatggagggcgagggggtgttcaagggcatccagcacctgacggccaccgaggaggtggcggtccaggactggctggcccgcgtgggccgggagcgcctctcccggatggccatcagcggggacgactgcgtggtcaagcccctggacgaccgcttcgccaacgccctgaccgcgctcaacgacatgggcaaggtgcggaaggacatccagcagtgggagccctcccgcgggtggaacgactggacccaggtgcccttctgcagccaccacttccacgagctgatcatgaaggacggccgggtcctggtggtgccgtgccgcaaccaggacgagctcatcgggcgggcccgcatctcccagggcgccggctggagcctgcgggagacggcctgcctggggaagtcctacgcccagatgtggagcctcatgtacttccaccgccgggacctgcgcctggcggccaacgccatctgctccgccgtccccagccactgggtgcccacctcccggaccacctggagcatccacgcgcgccacgagtggatgaccacggaggacatgctcaccgtgtggaaccgcgtctggatccaggagaacccctggatggaggacaagaccccggtggagtcctgggaggagatcccctacctgggcaagcgggaggaccagtggtgcgggagcctgatcggcctcaccagccgcgccacgtgggcccggaacatccagaccgccatcaaccaggtgcgctccctgatcgggagcgaggagtacaccgactacatgccctccatgaagcggttccgccgggaggaggaggaggccggcgtcctgtggtga

SEQ ID NO: 9319 - RNA, 9876 nt, synthetic construct
  misc_feature 1..9876: note = derived and/or modified CDS sequence (opt1) from DENV-2__KF955364__SS-prME
  source 1..9876: mol_type = other RNA
accgccggggtgatcatcatgctgatccccaccgccatggcgttccacctcaccacccggaacggggagccgcacatgatcgtcgggcggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacggcgtgaagctgaccatcatgaccggggacatcaagggcatcatgcaggccggcaagcggtccctgcgcccgcagcccaccgagctcaagtacagctggaagacgtgggggaaggccaagatgctgtccaccgagagccacaaccagaccttcctgatcgacggccccgagaccgcggagtgcccgaacacgaaccgggcctggaactccctcgaggtcgaggactacgggttcggcgtgttcagcaccaacatctggctgaagctgcgcgagaagcaggacgtgctctgcgactccaagctgatgagcgccgccatcaaggacaaccgggccgtccacgcggacatgggctactggatcgagtccgccctgaacgacacctggaagatggagaaggccagcttcatcgagatcaagtcctgccactggcccaagagccacaccctctggtccaacggggtgctggagagcgagatgatcatccccaagaacttcgccggccccgtgtcccagcacaactaccgcccggggtaccacacccagacggccggcccctggcacctggggaagctcgagatggacttcgacttctgcgagggcaccaccgtcgtggtgaccgaggactgcggcaaccgggggcccagcctgcgcacgaccaccgcgagcggcaagctgatcaccgagtggtgctgccggtcctgcacgctcccgcccctgcgctaccgcggggaggacggctgctggtacgggatggagatccgccccctgaaggagaaggaggagaacctcgtcaacagcctggtgaccgccggccacggccagatcgacaacttctccctgggggtgctcggcatggccctgttcctggaggagatgctccggacccgcgtcgggaccaagtacgccatcctgctggtggcggtgagcttcgtcacgctcatcaccggcaacatgtccttccgggacctggggcgcgtgatggtgatggtcggcgccaccatgaccgacgacatcggcatgggggtgacgtacctggccctcctggccgccttcaaggtgcgccccaccttcgcggccggcctgctcctgcggaagctgaccagcaaggagctcatgatggccaccatcgggatcgccctgctgtcccagagcacgatccccgagaccatcctcgagctgaccgacgccctggcgctcggcatgatggtcctgaagatcgtgcgcaacatggagaagtaccagctggccgtgaccatcatggccatctcctgcgtccccaacgccgtgatcctccagaacgcctggaaggtgagctgcacgatcctggcggccgtctccgtgagccccctgctcctgacctccagccagcagaaggccgactggatccccctggccctcaccatcaagggcctgaaccccaccgcgatcttcctgacgaccctctcccggaccagcaagaagcgctcctggccgctgaacgaggccgtcatggccgtggggatggtgagcatcctggcctccagcctcctgaagaacgacatccccatgaccggccccctggtcgccgggggcctcctgacggtgtgctacgtgctgaccgggcggagcgcggacctcgagctggagcgcgccgccgacgtcaagtgggaggaccaggccgagatctccggcagctcccccatcctgagcatcaccatctccgaggacggcagcatgtccatcaagaacgaggaggaggagcacaccctcacgatcctgatccggaccgggctgctcgtgatcagcggcgtgttcccggtctccatccccatcaccgccgcggcctggtacctgtgggaggtgaagaagcagcgcgccggggtgctgtgggacgtcccctccccgccgcccgtgggcaaggccgagctcgaggacggggcctaccggatcaagcagcgcggcatcttcggctactcccagatcggggcgggcgtgtacaaggaggggaccttccacaccatgtggcacgtcacgcggggcgccgtgctgatgcaccgcgggaagcggatcgagcccagctgggccgacgtgaagaaggacctgatctcctacggcggcgggtggaagctcgagggcgagtggaaggagggggaggaggtccaggtgctggccctggagcccggcaagaacccccgcgccgtgcagaccaagcccggcctcttcaagaccaacaccggcacgatcggcgcggtcagcctggacttctcccccgggaccagcggctcccccatcgtggaccggaaggggaaggtggtcggcctgtacggcaacggggtggtgacccgcagcggcgcctacgtctccgccatcgcccagaccgagaagtccatcgaggacaaccccgagatcgaggacgacatcttccggaagaagcgcctcacgatcatggacctgcaccccggggcgggcaagaccaagcggtacctgcccgccatcgtgcgcgaggccatcaagcgggggctgcgcaccctcatcctggccccgacccgcgtggtcgccgcggagatggaggaggccctgcggggcctccccatccgctaccagacgcccgccatccgggccgagcacaccggccgcgagatcgtggacctgatgtgccacgccaccttcaccatgcggctgctcagccccgtgcgcgtcccgaactacaacctgatcatcatggacgaggcgcacttcacggaccccgcctccatcgccgcccgggggtacatcagcacccgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtgacggacttcaagggcaagaccgtctggttcgtgccgtccatcaaggccggcaacgacatcgcggcctgcctgcgcaagaacgggaagaaggtgatccagctcagccggaagaccttcgactccgagtacgtcaagacccgcgccaacgactgggacttcgtggtgacgaccgacatcagcgagatgggcgccaacttccgggccgagcgcgtcatcgacccccggcgctgcatgaagcccgtgatcctgaccgacggggaggagcgggtgatcctggcgggccccatgccggtcacccactccagcgccgcccagcgccgcgggcggatcggccgcaaccccaagaacgagaacgaccagtacatctacatgggcgagcccctcgagaacgacgaggactgcgcccactggaaggaggccaagatgctgctggacaacatcaacacgcccgaggggatcatcccgtccatgttcgagcccgagcgggagaaggtggacgcgatcgacggcgagtaccgcctccgcggggaggcccgcaagaccttcgtggacctgatgcggcgcggcgacctgcccgtctggctcgcctaccgggtggccgccgaggggatcaactacgcggaccgccggtggtgcttcgacggcatcaagaacaaccagatcctggaggagaacgtggaggtcgagatctggaccaaggagggcgagcgcaagaagctgaagccgcggtggctcgacgcccgcatctacagcgaccccctggccctgaaggagttcaaggagttcgccgcggggcggaagtccctcaccctgaacctgatcacggagatgggccgcctccccaccttcatgacccagaaggcccgggacgccctggacaacctggccgtgctccacaccgccgaggtcgggggccgcgcgtacaaccacgccctgagcgagctgcccgagacgctcgagaccctgctgctcctgaccctgctcgccaccgtgacgggcgggatcttcctgttcctgatgtccggcaaggggatcggcaagatgaccctcgggatgtgctgcatcatcaccgccagcatcctgctgtggtacgcccagatccagccgcactggatcgcggcctccatcatcctcgagttcttcctgatcgtgctgctcatccccgagcccgagaagcagcggacgccccaggacaaccagctgacctacgtcgtgatcgccatcctgacggtggtcgccgccaccatggcgaacgagatgggcttcctcgagaagaccaagaaggacctgggcctggggagcatcaccacgcaggagagcgagtccaacatcctcgacatcgacctgcgcccggccagcgcctggaccctgtacgccgtggccaccaccttcgtgacgcccatgctccggcactccatcgagaacagctccgtcaacgtgagcctgaccgcgatcgccaaccaggccaccgtgctgatgggcctcgggcgcggctggcccctgtccaagatggacatcggggtccccctgctcgccatcggctgctacagccaggtgaacccgatcaccctgacggcggccctgctcctgctggtggcccactacgccatcatcggccccgggctccaggccaaggcgacccgcgaggcccagaagcggaccgccgccggcatcatgaagaaccccaccgtcgacgggatcacggtgatcgacctggagcccatcccgtacgaccccaagttcgagaagcagctgggccaggtgatgctcctggtcctgtgcgtgacccaggtgctcatgatgcgcaccacctgggccctgtgcgaggcgctgacgctcgccaccgggcccatctccaccctgtgggagggcaaccccggccggttctggaacaccacgatcgccgtcagcatggccaacatcttccgcgggtcctacctggccggcgcggggctcctgttcagcatcatgaagaacaccaccaacacccggcgcggcacgggcaacatcggggagaccctgggcgagaagtggaagtcccggctcaacgccctgggcaagagcgagttccagatctacaagaagtccggcatccaggaggtggaccgcaccctggccaaggaggggatcaagcggggcgagaccgaccaccacgccgtgagccgcggctccgcgaagctccggtggttcgtcgagcgcaacatggtgacgccggaggggaaggtggtcgacctgggctgcgggcggggcgggtggagctactactgcggcggcctgaagaacgtgcgcgaggtgaaggggctcaccaagggcgggcccggccacgaggagcccatccccatgtccacctacgggtggaacctggtccggctgcagagcggcgtggacgtgttcttcaccccgcccgagaagtgcgacacgctcctgtgcgacatcggcgagagctcccccaaccccaccatcgaggccgggcgcaccctgcgggtcctcaacctggtggagaactggctgaacaacaacacccagttctgcgtgaaggtcctcaacccgtacatgcccagcgtgatcgagaagatggagaccctgcagcgcaagtacggcggggccctggtgcggaaccccctgtcccgcaacagcacgcacgagatgtactgggtctccaacgccaccggcaacatcgtgagctccgtgaacatgatcagccgcatgctcatcaaccggttcaccatgaagcacaagaaggccacctacgagccggacgtcgacctggggtccggcacgcgcaacatcggcatcgagaacgagatccccaacctggacatcatcgggaagcggatcgagaagatcaagcaggagcacgagaccagctggcactacgaccaggaccacccctacaagacctgggcgtaccacggctcctacgagaccaagcagacggggagcgcctccagcatggtgaacggcgtggtcaagctcctgaccaagccctgggacgtggtgccgatggtcacccagatggccatgaccgacacgacccccttcggccagcagcgcgtgttcaaggagaaggtggacacccggacccaggagcccaaggaggggacgaagaagctgatgcgcatcaccgccgagtggctctggaaggagctgggcaagaagaagacgccccggatgtgcacccgcgaggagttcacgcggaaggtccgctccaacgccgcgctgggggccatcttcaccgacgagaacaagtggaagtccgcccgggaggccgtggaggactcccgcttctgggagctcgtcgaccgggagcgcaacctgcacctggagggcaagtgcgagacctgcgtgtacaacatgatggggaagcgggagaagaagctcggcgagttcggcaaggccaaggggagccgcgcgatctggtacatgtggctgggcgcccggttcctggagttcgaggccctcgggttcctgaacgaggaccactggttctcccgcggcaacagcctgagcggggtggagggcgagggcctccacaagctggggtacatcctgcgggacgtctccaagaaggagggcggggccatgtacgcggacgacaccgccggctgggacacgcgcatcaccctcgaggacctgaagaacgaggagatggtgaccaaccacatgaagggggagcacaagaagctggccgaggccatcttcaagctcacctaccagaacaaggtggtccgggtgcagcgcccgacgccccgcggcaccgtgatggacatcatcagccggaaggaccagcgcggctccgggcaggtcggcacctacgggctgaacaccttcacgaacatggaggcccagctgatccggcagatggagggcgagggcatcttcaagagcatccagcgcctcaccgtgaccgaggagatcgcggtgcagaactggctggcccgggtcgggcgcgagcggctgtcccgcatggccatcagcggcgacgactgcgtggtgaagcccctcgacgaccggttcgcctccgccctgaccgcgctgaacgacatggggaaggtccgcaaggacatccagcagtgggagcccagccggggctggaacgactggacccaggtgccgttctgctcccaccacttccacgagctcgtgatgaaggacgggcgcgtcctggtggtgccctgccggaaccaggacgagctgatcggccgcgcccggatcagccagggcgccgggtggtccctcaaggagaccgcctgcctgggcaagagctacgcccagatgtggaccctgatgtacttccaccgccgggacctccgcctggcggccaacgccatctgctccgccgtccccagccactgggtgcccacctcccggaccacgtggagcatccacgccaagcacgagtggatgaccaccgaggacatgctggcggtgtggaaccgcgtctggatccaggagaacccgtggatggaggacaagacccccgtggagtcctgggaggaggtgccctacctcgggaagcgcgaggaccagtggtgcggcagcctgatcgggctgacgagccgggccacctgggccaagaacatccagaccgccatcaaccaggtccgctccctcatcggcaacgaggagtacaccgactacatgcccagcatgaagcggttccgcaaggaggaggaggaggcgggcgtgctgtggtga

SEQ ID NO: 9320 - RNA, 9876 nt, synthetic construct
  misc_feature 1..9876: note = derived and/or modified CDS sequence (opt1) from DENV-2__KF955372__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagtacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacgtggaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgactccggctgcgtggtcagctggaagaacaaggagctgaagtgcggctccgggatcttcatcaccgacaacgtgcacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtcaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtggaggactacggcttcggggtgttctccacgaacatctggctgaagctgcgcgagaagcaggacgtcttctgcgacagcaagctcatgtccgccgccatcaaggacaaccgggccgtgcacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtcgtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtcacggccgggcacggccagatcgacaacttcagcctgggcgtgctggggatggccctcttcctggaggagatgctgcggacccgcgtgggcaccaagcacgccatcctcctggtcgcggtgtccttcgtgaccctgatcacggggaacatgagcttccgggacctcggccgcgtcatggtgatggtgggggccaccatgaccgacgacatcggcatgggcgtcacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtccgcaacatggagaagtaccagctggccgtgaccatcatggccatcagctgcgtgccgaacgccgtcatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtcggcatggtgtccatcctggccagcagcctgctcaagaacgacatccccatgaccgggcccctggtggccggcgggctgctcaccgtctgctacgtgctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtcatctccggggtgttcccggtgagcatccccatcaccgccgcggcctggtacctctgggaggtcaagaagcagcgcgccggcgtgctgtgggacgtgcccagcccgccgcccgtcgggaaggccgagctggaggacggcgcctaccggatcaagcagcgcgggatcttcggctacagccagatcggcgcgggggtgtacaaggagggcaccttccacaccatgtggcacgtgacccgcggggccgtcctcatgcaccgcggcaagcggatcgagccctcctgggccgacgtgaagaaggacctgatcagctacgggggcggctggaagctggagggggagtggaaggagggcgaggaggtgcaggtcctcgccctggagcccgggaagaacccccgcgccgtgcagacgaagcccggcctgttcaagaccaacaccgggaccatcggcgcggtgtccctcgacttcagccccggcacgtccgggagccccatcgtcgaccggaagggcaaggtggtggggctgtacggcaacggcgtcgtgacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtccgcgaggccatcaagcggggcctgcgcaccctgatcctcgccccgacccgcgtggtggccgcggagatggaggaggccctgcgggggctgcccatccgctaccagacccccgccatccgggccgagcacacgggccgcgagatcgtcgacctcatgtgccacgccaccttcaccatgcggctgctgtcccccgtgcgcgtgccgaactacaacctcatcatcatggacgaggcgcacttcaccgaccccgccagcacggccgcccggggctacatctccacccgcgtcgagatgggggaggccgcgggcatcttcatgaccgccacgccgcccgggagccgggacccgttcccccagtccaacgcccccatcatggacgaggagcgcgagatccccgagcggagctggaactccggccacgagtgggtgacggacttcaaggggaagaccgtgtggttcgtcccgagcatcaaggccggcaacgacatcgcggcctgcctgcgcaagaacggcaagaaggtgatccagctgtcccggaagaccttcgacagcgagtacgtgaagacccgcgccaacgactgggacttcgtcgtgacgaccgacatctccgagatgggggccaacttccgggccgagcgcgtgatcgacccccggcgctgcatgaagcccgtcatcctcaccgacggcgaggagcgggtgatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgggagaaggtcgacgcgatcgacggggagtaccgcctgcggggcgaggcccgcaagaccttcgtggacctcatgcggcgcggggacctgcccgtgtggctggcctaccgggtcgccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcacggagatggggcgcctgcccaccttcatgacccagaaggcccgggacgccctcgacaacctggccgtgctgcacaccgccgaggtgggcgggcgcgcgtacaaccacgccctctccgagctgcccgagacgctggagaccctcctgctgctcaccctgctggccaccgtcacgggcggcatcttcctcttcctgatgagcgggaagggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtggtcatcgccatcctgacggtggtggccgccaccatggcgaacgagatggggttcctggagaagaccaagaaggacctcggcctgggcagcatcaccacgcaggagtccgagagcaacatcctggacatcgacctccgcccggcctccgcctggaccctgtacgccgtcgccaccaccttcgtgacgcccatgctgcggcacagcatcgagaactccagcgtgaacgtctccctcaccgcgatcgccaaccaggccaccgtgctgatggggctgggccgcgggtggcccctcagcaagatggacatcggcgtgcccctgctggccatcgggtgctactcccaggtcaacccgatcaccctcacggcggccctgctgctcctggtggcccactacgccatcatcggccccggcctgcaggccaaggcgacccgcgaggcccagaagcgggccgccgccgggatcatgaagaaccccaccgtggacggcatcaccgtcatcgacctcgagcccatcccgtacgaccccaagttcgagaagcagctgggccaggtgatgctgctcgtgctgtgcgtcacccaggtgctgatgatgcgcaccacctgggcgctctgcgaggccctgaccctggccacgggccccatcagcaccctctgggaggggaaccccggccggttctggaacaccaccatcgccgtgtccatggccaacatcttccgcggcagctacctggcgggggccggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtcgaccgcaccctggccaaggagggcatcaagcgcggggagaccgaccaccacgcggtgtcccgcggcagcgccaagctgcggtggttcgtggagcgcaacatggtcaccccggagggcaaggtggtggacctcgggtgcggccgcggcgggtggtcctactactgcggcgggctgaagaacgtccgcgaggtgaaggggctgacgaagggcgggcccgggcacgaggagcccatccccatgagcacctacggctggaacctcgtgcggctgcagagcggggtcgacgtgttcttcaccccgcccgagaagtgcgacaccctgctctgcgacatcggcgagtccagccccaaccccacgatcgaggccggccgcaccctgcgggtgctgaacctcgtcgagaactggctgaacaacaacacccagttctgcatcaaggtgctgaacccgtacatgccctccgtgatcgagaagatggagaccctccagcgcaagtacgggggcgccctggtccggaaccccctgagccgcaactccacccacgagatgtactgggtgagcaacgccacggggaacatcgtgtccagcgtcaacatgatctcccgcatgctgatcaaccggttcaccatgaagcacaagaaggcgacctacgagccggacgtggacctcggcagcgggacccgcaacatcggcatcgagaacgagatccccaacctggacatcatcggcaagcggatcgagaagatcaagcaggagcacgagacgtcctggcactacgaccaggaccacccctacaagacctgggcctaccacgggagctacgagaccaagcagaccggctccgccagctccatggtgaacggggtcgtgcgcctgctcacgaagccctgggacgtggtcccgatggtgacccagatggccatgaccgacaccacgcccttcggccagcagcgggtgttcaaggagaaggtcgacacccgcacccaggagcccaaggagggcaccaagaagctgatgcggatcacggccgagtggctgtggaaggagctcgggaagaagaagacgccccggatgtgcacccgggaggagttcacccgcaaggtgcggagcaacgcggccctgggcgccatcttcacggacgagaacaagtggaagtccgcccgcgaggccgtcgaggacagccggttctgggagctggtggaccgcgagcggaacctccacctggaggggaagtgcgagacctgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaacagcctgtccggcgtcgagggggagggcctgcacaagctcggctacatcctgcgcgacgtgagcaagaaggagggcggggcgatgtacgccgacgacaccgccgggtgggacacccggatcacgctggaggacctcaagaacgaggagatggtgaccaaccacatgaagggcgagcacaagaagctggccgaggccatcttcaagctgacctaccagaacaaggtcgtgcgcgtgcagcgcccgacgccccgggggacggtcatggacatcatctcccgcaaggaccagcggggcagcggccaggtggggacctacggcctcaacaccttcaccaacatggaggcgcagctgatccgccagatggagggggagggcatcttcaagtccatccagcggctgacggtgaccgaggagatcgccgtccagaactggctcgcccgcgtgggccgggagcgcctgagccggatggccatctccggggacgactgcgtggtcaagcccctggacgaccgcttcgccagcgcgctcaccgccctgaacgacatgggcaaggtgcggaaggacatccagcagtgggagccctcccgcgggtggaacgactggacccaggtgccgttctgcagccaccacttccacgagctggtcatgaaggacggccgggtgctcgtggtcccctgccgcaaccaggacgagctgatcgggcgggcccgcatctcccagggcgccggctggagcctgaaggagacggcctgcctcgggaagtcctacgcgcagatgtggaccctgatgtacttccaccggcgcgacctgcggctcgccgccaacgccatctgcagcgccgtgccctcccactgggtgcccaccagccgcaccacctggtccatccacgcgaagcacgagtggatgacgaccgaggacatgctggccgtctggaaccgcgtgtggatccaggagaacccgtggatggaggacaagacccccgtggagagctgggaggaggtcccctacctgggcaagcgggaggaccagtggtgcgggagcctcatcggcctgacctcccgcgccacgtgggccaagaacatccagaccgcgatcaaccaggtgcggagcctgatcgggaacgaggagtacaccgactacatgccctccatgaagcgcttccggaaggaggaggaggaggccggcgtgctctggtga

SEQ ID NO: 9321 - RNA, 9876 nt, synthetic construct
  misc_feature 1..9876: note = derived and/or modified CDS sequence (opt1) from DENV-2__KF955373__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccgctcagcatccccatcaccgccgcggcctggtacctgtgggaggtgaagaagcagcgcgccggcgtgctgtgggacgtccccagcccgccgcccgtggggaaggccgagctcgaggacggcgcctaccggatcaagcagcgcgggatcttcggctacagccagatcggcgcgggggtgtacaaggagggcaccttccacaccatgtggcacgtcacccgcggggccgtgctgatgcaccgcggcaagcggatcgagccctcctgggccgacgtgaagaaggacctgatcagctacgggggcggctggaagctcgagggggagtggaaggagggcgaggaggtccaggtgctggccctggagcccgggaagaacccccgcgccgtgcagacgaagcccggcctcttcaagaccaacaccgggaccatcggcgcggtctccctggacttcagccccggcacgtccgggagccccatcgtggaccggaagggcaaggtggtcgggctgtacggcaacggcgtggtgacccgctccggggcctacgtcagcgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtggtcgccgcggagatggaggaggccctgcgggggctccccatccgctaccagacccccgccatccgggccgagcacacgggccgcgagatcgtggacctgatgtgccacgccaccttcaccatgcggctgctctcccccgtgcgcgtcccgaactacaacctgatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggccggcaacgacatcgcggcctgcctgcgcaagaacggcaagaaggtgatccagctctcccggaagaccttcgacagcgagtacgtcaagacccgcgccaacgactgggacttcgtggtgaccacggacatctccgagatgggggccaacttccgggccgagcgcgtcatcgacccccggcgctgcatgaagcccgtgatcctgaccgacggcgaggagcgggtgatcctggcggggcccatgccggtcacccacagctccgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgggagaaggtggacgcgatcgacggggagtaccgcctccggggcgaggcccgcaagacgttcgtggacctgatgcggcgcggggacctgcccgtctggctcgcctaccgggtggccgccgagggcatcaactacgcggaccgccggtggtgcttcgacgggatcaagaacaaccagatcctggaggagaacgtggaggtcgagatctggaccaaggagggcgagcgcaagaagctgaagccgcggtggctcgacgcccgcatctactccgaccccctggccctgaaggagttcaaggagttcgccgcgggccggaagtccctcaccctgaacctgatcaccgagatggggcgcctccccacgttcatgacccagaaggcccgggacgccctggacaacctggccgtgctccacaccgccgaggtcggcgggcgcgcgtacaaccacgccctgtccgagctgcccgagaccctcgagacgctgctgctcctgaccctgctcgccaccgtgaccggcggcatcttcctgttcctgatgagcgggaagggcatcgggaagatgacgctcggcatgtgctgcatcatcaccgcctccatcctgctgtggtacgcccagatccagccgcactggatcgcggccagcatcatcctcgagttcttcctgatcgtgctgctcatccccgagcccgagaagcagcggacgccccaggacaaccagctgacctacgtcgtgatcgccatcctgaccgtggtcgccgccacgatggcgaacgagatggggttcctcgagaagaccaagaaggacctgggcctgggcagcatcaccacccaggagtccgagagcaacatcctcgacatcgacctgcgcccggcctccgcctggacgctgtacgccgtggccaccaccttcgtgacccccatgctccggcacagcatcgagaactccagcgtcaacgtgtccctgacggcgatcgccaaccaggccaccgtgctgatggggctcggccgcgggtggcccctgagcaagatggacatcggcgtccccctgctcgccatcgggtgctactcccaggtgaacccgatcaccctgaccgcggccctgctcctgctggtggcccactacgccatcatcggccccggcctccaggccaaggcgacgcgcgaggcccagaagcgggccgccgccgggatcatgaagaaccccaccgtcgacggcatcaccgtgatcgacctggagcccatcccgtacgaccccaagttcgagaagcagctgggccaggtgatgctcctggtcctgtgcgtgacccaggtgctcatgatgcgcacgacctgggcgctgtgcgaggccctgaccctcgccaccggccccatcagcacgctgtgggaggggaaccccggccggttctggaacaccaccatcgccgtctccatggccaacatcttccgcggcagctacctggcgggggccggcctcctgttctccatcatgaagaacaccacgaacacccggcgcgggaccggcaacatcggcgagaccctgggggagaagtggaagtcccggctcaacgccctgggcaagtccgagttccagatctacaagaagtccgggatccaggaggtggaccgcacgctggccaaggagggcatcaagcgcggggagaccgaccaccacgcggtgtcccgcggcagcgccaagctccggtggttcgtcgagcgcaacatggtgaccccggagggcaaggtggtcgacctggggtgcggccgcggcgggtggtcctactactgcggcgggctgaagaacgtgcgcgaggtgaaggggctcaccaagggcgggcccgggcacgaggagcccatccccatgagcacgtacggctggaacctggtccggctgcagagcggggtggacgtgttcttcaccccgcccgagaagtgcgacaccctcctgtgcgacatcggcgagtccagccccaaccccaccatcgaggccggccgcacgctgcgggtcctcaacctggtggagaactggctgaacaacaacacccagttctgcatcaaggtgctcaacccgtacatgccctccgtcatcgagaagatggagaccctgcagcgcaagtacgggggcgccctggtgcggaaccccctgagccgcaactccacccacgagatgtactgggtgagcaacgccaccgggaacatcgtctccagcgtgaacatgatctcccgcatgctcatcaaccggttcacgatgaagcacaagaaggcgacctacgagccggacgtggacctgggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtcaacggggtggtgaagctcctgaccaagccctgggacgtcgtgccgatggtgacgcagatggccatgaccgacaccacccccttcggccagcagcgcgtcttcaaggagaaggtggacacgcggacccaggagcccaaggagggcaccaagaagctgatgcgcatcaccgccgagtggctctggaaggagctggggaagaagaagacgccccggatgtgcacccgcgaggagttcacccggaaggtgcgcagcaacgcggccctgggcgccatcttcaccgacgagaacaagtggaagtccgcccgggaggccgtcgaggacagccgcttctgggagctcgtggaccgggagcgcaacctgcacctggaggggaagtgcgagacgtgcgtctacaacatgatgggcaagcgggagaagaagctcggggagttcggcaaggcgaagggctcccgcgccatctggtacatgtggctgggggcccggttcctggagttcgaggccctcggcttcctgaacgaggaccactggttcagccgcgggaacagcctgtccggcgtggagggggagggcctccacaagctgggctacatcctgcgggacgtgagcaagaaggagggcggggcgatgtacgccgacgacaccgccgggtgggacacccgcatcaccctcgaggacctgaagaacgaggagatggtcacgaaccacatgaagggcgagcacaagaagctggccgaggccatcttcaagctcacctaccagaacaaggtggtgcgggtccagcgcccgacgccccgggggaccgtgatggacatcatctcccggaaggaccagcgcggcagcggccaggtggggacgtacggcctgaacaccttcaccaacatggaggcgcagctgatccggcagatggagggggagggcatcttcaagtccatccagcgcctcaccgtcacggaggagatcgccgtgcagaactggctggcccgggtgggccgcgagcggctgagccgcatggccatctccggggacgactgcgtcgtgaagcccctcgacgaccggttcgccagcgcgctgaccgccctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggaaccaggacgagctgatcgggcgcgcccggatctcccagggcgccggctggagcctcaaggagaccgcctgcctggggaagtcctacgcgcagatgtggacgctgatgtacttccaccgccgggacctccgcctggccgccaacgccatctgcagcgccgtgccctcccactgggtccccaccagccggaccacctggtccatccacgcgaagcacgagtggatgaccacggaggacatgctggccgtgtggaaccgcgtgtggatccaggagaacccgtggatggaggacaagacccccgtcgagagctgggaggaggtgccctacctcggcaagcgcgaggaccagtggtgcgggagcctgatcggcctgacctcccgggccacctgggccaagaacatccagacggcgatcaaccaggtgcgcagcctcatcgggaacgaggagtacaccgactacatgccctccatgaagcggttccgcaaggaggaggaggaggccggcgtcctgtggtga

SEQ ID NO: 9322 - RNA, 9876 nt, synthetic construct
  misc_feature 1..9876: note = derived and/or modified CDS sequence (opt1) from DENV-2__GQ868600__SS-prME
  source 1..9876: mol_type = other RNA
accgcgggcatgatcatcatgctgatccccaccgtgatggccttccacctcaccacccgcaacggggagccccacatgatcgtgagccggcaggagaagggcaagagcctgctgttcaagaccaaggacgggaccaacatgtgcaccctcatggcgatggacctgggcgagctgtgcgaggacaccatcacctacaagtgccccttcctcaagcagaacgagcccgaggacatcgactgctggtgcaacagcacctccacctgggtgacctacgggacctgcaccacgaccggcgagcaccgccgggagaagcgcagcgtggccctggtcccccacgtgggcatggggctggagacccggaccgagacgtggatgtccagcgagggcgcctggaagcacgcccagcgcatcgagacctggatcctccggcaccccgggttcaccatcatggccgcgatcctggcctacaccatcggcacgacccacttccagcgcgtgctgatcttcatcctcctgaccgccatcgccccctccatgaccatgcggtgcatcgggatcagcaaccgcgacttcgtcgagggcgtgtccggcgggagctgggtggacatcgtcctggagcacggctcctgcgtgacgaccatggcgaagaacaagcccaccctcgacttcgagctgatcaagaccgaggccaagcagcccgccacgctgcggaagtactgcatcgaggccaagctcaccaacaccaccacggacagccgctgcccgacccagggggagcccaccctgaacgaggagcaggacaagcggttcgtgtgcaagcactccatggtcgaccgcggctggggcaacgggtgcggcctgttcgggaagggcgggatcgtgacctgcgccatgttcacgtgcaagaagaacatggagggcaagatcgtgcagcccgagaacctcgagtacaccgtcgtgatcacgccccacagcggcgaggagcacgcggtggggaacgacaccggcaagcacgggaaggaggtcaagatcaccccgcagtccagcatcacggaggccgagctgaccggctacgggaccgtgaccatggagtgcagcccccggacgggcctggacttcaacgagatggtgctcctgcagatggaggacaaggcctggctggtccaccgccagtggttcctcgacctgcccctgccctggctcccgggcgccgacacccaggggagcaactggatccagaaggagaccctggtgaccttcaagaacccccacgccaagaagcaggacgtggtcgtgctgggctcccaggagggggcgatgcacacggccctcaccggcgccaccgagatccagatgagcagcgggaacctgctgttcaccggccacctcaagtgccggctgcgcatggacaagctgcagctcaagggcatgtcctacagcatgtgcacggggaagttcaagatcgtcaaggagatcgccgagacccagcacggcaccatcgtgatccgggtgcagtacgagggggacggctccccctgcaagatccccttcgagatcatggacctggagaagcgccacgtcctgggccggctcatcaccgtgaacccgatcgtgacggagaaggacagccccgtcaacatcgaggccgagccgcccttcggggactcctacatcatcatcggcgtggagccggggcagctgaagctggactggttcaagaagggcagctccatcgggcagatgttcgagaccaccatgcgcggcgcgaagcgcatggccatcctcggcgacaccgcctgggacttcgggagcctgggcggggtgttcacgtccatcggcaaggccctgcaccaggtcttcggggccatctacggcgcggccttcagcggcgtgtcctggaccatgaagatcctcatcggggtgatcatcacctggatcggcatgaacagccggtccaccagcctgtccgtcagcctggtgctggtggggatcgtcacgctctacctgggcgtgatggtgcaggccgactccgggtgcgtcgtgagctggaagaacaaggagctgaagtgcggctccggcatcttcgtgaccgacaacgtccacacctggaccgagcagtacaagttccagcccgagagccccagcaagctcgcctccgcgatccagaaggcccacgaggaggggatctgcggcatccgcagcgtgacgcggctggagaacctgatgtggaagcagatcacctccgagctcaaccacatcctgagcgagaacgaggtgaagctgaccatcatgaccggggacatcaagggcatcatgcaggtcgggaagcgctccctccggccccagccgacggagctgcgctacagctggaagacctggggcaaggccaagatgctgtccaccgagctccacaaccagaccttcctgatcgacggccccgagacggccgagtgccccaacaccaaccgggcctggaacagcctggaggtggaggactacgggttcggcgtgttcaccaccaacatctggctccgcctgcgggagaagcaggacgcgttctgcgactccaagctgatgagcgccgccatcaaggacaaccgcgccgtccacgccgacatggggtactggatcgagtccgcgctcaacgacacctggaagatcgagaaggccagcttcatcgaggtgaagtcctgccactggcccaagtcccacacgctgtggtccaacggcgtgctggagagcgagatggtcatccccaagaacttcgccggccccgtgtcccagcacaacaaccggcccgggtaccacacccagaccgccggcccgtggcacctcgggaagctggagatggacttcgacttctgcgagggcaccacggtggtcgtgaccgaggactgcgggaaccgcggccccagcctgcggaccaccacggccagcggcaagctcatcaccgagtggtgctgccgctcctgcaccctgccgcccctgcggtaccgcggggaggacggctgctggtacgggatggagatccggccgctcaaggagaaggaggagaacctggtgagctccctggtcaccgcgggccacgggcagatcgacaacttcagcctcggcatcctgggcatggccctgttcctcgaggagatgctgcgcacgcgggtggggaccaagcacgccatcctgctcgtggccgtctccttcgtgaccctgatcaccggcaacatgagcttccgcgacctggggcgcgtgatggtcatggtgggcgcgacgatgaccgacgacatcgggatgggcgtgacctacctcgccctgctggccgccttcaaggtccggcccaccttcgccgcgggcctcctgctgcgcaagctcacgtccaaggagctgatgatgaccaccatcgggatcgtgctgctcagccagtccagcatccccgagaccatcctggagctgacggacgccctcgccctgggcatgatggtgctgaagatggtccggaacatggagaagtaccagctcgccgtgaccatcatggccatcctgtgcgtgcccaacgcggtcatcctgcagaacgcctggaaggtgtcctgcaccatcctcgccgtcgtgagcgtgtccccgctgctgctcaccagctcccagcagaaggccgactggatccccctggccctgacgatcaaggggctcaaccccaccgcgatcttcctgaccaccctgagccgcacgtccaagaagcggagctggcccctcaacgaggccatcatggccgtcggcatggtgtccatcctggccagcagcctgctcaagaacgacatcccgatgaccggccccctggtggccggcgggctgctcaccgtctgctacgtgctgaccgggcgctccgccgacctggagctcgagcgggccacggacgtgaagtgggacgaccaggccgagatcagcgggtccagccccatcctgtccatcaccatcagcgaggacgggtccatgagcatcaagaacgaggaggaggagcagaccctgaccatcctcatccgcaccggcctgctggtcatctccggcctcttccccgtgagcatcccgatcacggccgcggcctggtacctgtgggaggtgaagaagcagcgggccggggtcctgtgggacgtgcccagcccgccgcccgtgggcaaggccgagctcgaggacggggcctaccgcatcaagcagaagggcatcctggggtacagccagatcggcgcgggcgtctacaaggaggggaccttccacaccatgtggcacgtgacccggggcgccgtgctgatgcacaaggggaagcgcatcgagccctcctgggccgacgtcaagaaggacctcatcagctacggcgggggctggaagctggagggcgagtggaaggagggggaggaggtccaggtgctggccctcgagcccggcaagaacccccgggccgtccagacgaagcccgggctgttccgcaccaacaccggcaccatcggggcggtgtccctggacttcagccccggcacgtccggcagccccatcgtggacaagaaggggaaggtcgtgggcctctacgggaacggcgtggtcacccggtccggcgcctacgtgagcgccatcgcccagaccgagaagtccatcgaggacaacccggagatcgaggacgacatcttccgcaagcggcgcctgaccatcatggacctgcaccccggggccggcaagacgaagcggtacctgcccgcgatcgtgcgcgaggccatcaagcgggggctccgcaccctgatcctggcccccacccgcgtcgtggccgcggagatggaggaggccctccggggcctgccgatccgctaccagacccccgccatccgggccgagcacacggggcgcgagatcgtggacctgatgtgccacgccaccttcaccatgcggctcctgagccccatccgcgtccccaactacaacctgatcatcatggacgaggcgcacttcaccgacccggccagcatcgccgcccggggctacatctccacgcgcgtggagatgggcgaggccgcggggatcttcatgaccgccacgccgcccggcagccgggaccccttcccgcagtccaacgcccccatcatggacgaggagcgcgagatccccgagcggagctggaactccgggcacgagtgggtgaccgacttcaagggcaagacggtctggttcgtgcccagcatcaagaccgggaacgacatcgccgcctgcctccgcaagaacggcaagcgggtgatccagctgtcccgcaagaccttcgacagcgagtacgtcaagacccggacgaacgactgggacttcgtggtgaccaccgacatctccgagatgggcgcgaacttcaaggccgagcgcgtcatcgacccgcggcgctgcatgaagcccgtgatcctgaccgacggggaggagcgggtgatcctcgccggccccatgcccgtcacgcacagctccgccgcgcagcgccgcgggcggatcggccgcaacccgcggaacgagaacgaccagtacatctacatgggggagcccctggagaacgacgaggactgcgcccactggaaggaggccaagatgctgctcgacaacatcaacacccccgagggcatcatccccagcatgttcgagccggagcgcgagaaggtggacgccatcgacggcgagtaccggctgcgcggggaggcccggaagaccttcgtggacctgatgcgccggggcgacctccccgtctggctggcgtacaaggtggccgccgaggggatcaactacgccgaccgccggtggtgcttcgacggcacccgcaacaaccagatcctggaggagaacgtggaggtcgagatctggacgaaggagggggagcggaagaagctcaagccccgctggctggacgcccggatctactccgacccgctggcgctcaaggagttcaaggagttcgccgccggccgcaagagcctgaccctgaacctcatcaccgagatgggccggctgcccaccttcatgacgcagaaggcccgcgacgccctggacaacctcgcggtgctgcacaccgccgaggccgggggcaaggcctacaaccacgcgctgtccgagctccccgagaccctggagaccctgctcctgctgaccctcctggccacggtcaccgggggcatcttcctgttcctcatgagcggccgggggatcggcaagatgaccctggggatgtgctgcatcatcaccgcctccatcctgctctggtacgcccagatccagccccactggatcgccgcgagcatcatcctggagttcttcctgatcgtgctcctgatcccggagcccgagaagcagcgcacgccccaggacaaccagctgacctacgtgatcatcgccatcctcaccgtcgtggccgccaccatggccaacgagatgggcttcctggagaagacgaagaaggacctggggctcggcaacatcgcgacccagcagcccgagagcaacatcctggacatcgacctgcggccggcctccgcctggaccctctacgccgtggccaccacgttcatcacccccatgctgcgccacagcatcgagaactccagcgtcaacgtgtccctgaccgcgatcgccaaccaggccaccgtgctcatgggcctggggaagggctggcccctgagcaagatggacatcggggtccccctcctggccatcggctgctactcccaggtgaacccgatcacgctgaccgccgcgctcctgctgctcgtggcccactacgccatcatcgggcccggcctgcaggccaaggcgacccgcgaggcccagaagcgggccgccgccggcatcatgaagaaccccaccgtcgacgggatcacggtgatcgacctggaccccatcccgtacgaccccaagttcgagaagcagctcggccaggtgatgctgctggtcctctgcgtgacccaggtgctgatgatgcgcaccacctgggcgctgtgcgaggccctcacgctggccaccgggcccgtcagcaccctgtgggagggcaaccccgggcggttctggaacaccacgatcgccgtgtccatggccaacatcttccgcggcagctacctcgcgggcgccgggctgctgttctccatcatgaagaacaccaccagcacccggcgcggcacggggaacatcggcgagaccctcggcgagaagtggaagtcccggctgaacgccctggggaagtccgagttccagatctacaagaagtccggcatccaggaggtggaccgcaccctcgccaaggaggggatcaagcggggcgagaccgaccaccacgccgtcagccgcgggtccgcgaagctgcggtggttcgtggagcgcaacctggtgacgccggagggcaaggtcgtggacctcggctgcgggcggggcgggtggagctactactgcggcgggctgaagaacgtgcgcgaggtcaagggcctgaccaagggcgggcccggccacgaggagcccatccccatgtccacctacgggtggaacctcgtgcggctgcagagcggcgtggacgtcttcttcgtgccgcccgagaagtgcgacaccctgctctgcgacatcggggagagctcccccaaccccaccgtggaggccggccgcacgctgcgggtcctgaacctcgtggagaactggctgaacaacaacacccagttctgcgtgaaggtcctgaacccgtacatgcccagcgtgatcgagcgcatggagaccctgcagcggaagtacggcggggccctcgtgcgcaaccccctgtcccgcaacagcacccacgagatgtactgggtctccaacgccagcggcaacatcgtgtccagcgtgaacatgatctcccggatgctgatcaaccgcttcacgatgcggcacaagaaggcgacctacgagccggacgtcgacctcgggagcggcacccgcaacatcgggatcgagtccgagacccccaacctggacatcatcggcaagcggatcgagaagatcaagcaggagcacgagacgagctggcactacgaccaggaccacccctacaagacctgggcctaccacggctcctacgagaccaagcagaccgggagcgcctccagcatggtgaacggcgtggtccgcctgctcacgaagccctgggacgtggtgccgatggtcacccagatggccatgaccgacaccacgcccttcgggcagcagcgggtgttcaaggagaaggtggacacccgcacccaggagcccaaggagggcaccaagaagctgatgaagatcacggccgagtggctgtggaaggagctcggcaagaagaagacgccccggatgtgcacccgcgaggagttcaccaagaaggtccggtccaacgcggccctgggggccatcttcacggacgagaacaagtggaagtccgcccgcgaggccgtggaggactcccggttctgggagctggtcgacaaggagcgcaacctccacctggagggcaagtgcgagacctgcgtgtacaacatgatggggaagcgggagaagaagctgggcgagttcgggaaggcgaagggcagccgcgccatctggtacatgtggctcggcgcccggttcctggagttcgaggccctggggttcctcaacgaggaccactggttcagccgcgagaactccctgagcggcgtggagggggagggcctgcacaagctcgggtacatcctgcgggaggtctccaagaaggagggcggcgccatgtacgcggacgacaccgccgggtgggacacccgcatcacgatcgaggacctgaagaacgaggagatgatcaccaaccacatggccggcgagcacaagaagctcgccgaggcgatcttcaagctgacctaccagaacaaggtggtgcgggtccagcgcccgacgccccgcgggaccgtgatggacatcatcagccggcgcgaccagcggggctccggccaggtgggcacctacggcctgaacaccttcaccaacatggaggcccagctcatccgccagatggagggggagggcatcttcaagagcatccagcacctgacggcctccgaggagatcgccgtccaggactggctggtgcgggtggggcgcgagcggctcagccgcatggccatctccggcgacgactgcgtcgtgaagcccctggacgaccggttcgcgcgcgccctgaccgccctcaacgacatgggcaaggtgcggaaggacatccagcagtgggagcccagccgcgggtggaacgactggacccaggtcccgttctgctcccaccacttccacgagctgatcatgaaggacggccggaccctggtggtgccctgccgcaaccaggacgagctcatcgggcgggcccgcatcagccagggcgccgggtggtccctgcgggagaccgcgtgcctgggcaagagctacgcccagatgtggtccctcatgtacttccaccgccgggacctgcgcctggccgccaacgccatctgcagcgcggtcccctcccactgggtgcccacgagccgcaccacctggagcatccacgcctcccacgagtggatgaccacggaggacatgctcaccgtgtggaacaaggtctggatcctggagaacccgtggatggaggacaagacccccgtggagagctgggaggagatcccctacctgggcaagcgggaggaccagtggtgcgggtccctcatcggcctgaccagccgcgccacgtgggccaagaacatccagaccgccatcaaccaggtgcggtccctgatcgggaacgaggagtacaccgactacatgcccagcatgaagcgcttccggcgcgaggaggaggaggcgggcgtcctctggtga

SEQ ID NO: 9323 - RNA, 9876 nt, synthetic construct
  misc_feature 1..9876: note = derived and/or modified CDS sequence (opt1) from DENV-2__KF955359__SS-prME
  source 1..9876: mol_type = other RNA
accgccggggtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccaccatggccgcgatcctggcctacaccatcgggacgacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcacgaccatggccaagaacaagcccaccctggacttcgagctgatcaagaccgaggccaagcagcccgccatcctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgccagcctcgtcctggtgggcatcgtgaccctgtacctcggggtcatggtgcaggcggacaccggctgcgtggtctcctggaagaacaaggagctgaagtgcggcagcgggatcttcatcacggacaacgtgcacacctggaccgagcagtacaagttccagcccgagtcccccagcaagctggccagcgccatccagaaggcccacgaggagggcatctgcgggatccggtccgtgacccgcctcgagaacctgatgtggaagcagatcacgcccgagctgaaccacatcctcagcgagaacgaggtcaagctgaccatcatgaccggcgacatcaaggggatcatgcaggccggcaagcggtccctgcgcccgcagcccaccgagctcaagtacagctggaagacgtggggcaaggcgaagatgctgtccaccgagagccacaaccagaccttcctgatcgacgggcccgagaccgccgagtgcccgaacacgaaccgggcctggaactccctcgaggtggaggactacggcttcggggtgttcagcaccaacatctggctgaagctgcgcgagaagcaggacgtcttctgcgactccaagctcatgagcgccgccatcaaggacaaccgggcggtgcacgccgacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtctcccagcacaactaccgcccgggctaccacacccagacggcggggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcgtgggcaccaagcacgcgatcctcctggtggccgtcagcttcgtgacgctgatcaccgggaacatgtccttccgggacctcggccgcgtgatggtcatggtgggggccaccatgaccgacgacatcggcatgggcgtgacgtacctggccctgctcgccgcgttcaaggtccgccccaccttcgccgccgggctgctgctccggaagctgaccagcaaggagctgatgatggccaccatcggcatcgccctcctgtcccagagcacgatccccgagaccatcctggagctcaccgacgcgctggccctggggatgatggtgctcaagatcgtgcgcaacatggagaagtaccagctggccgtcaccatcatggccatctcctgcgtgccgaacgccgtgatcctgcagaacgcgtggaaggtcagctgcacgatcctcgccgccgtgtccgtgagccccctgctgctcacctccagccagcagaaggccgactggatccccctggcgctgaccatcaagggcctcaaccccaccgccatcttcctgacgaccctgtcccggaccagcaagaagcgctcctggccgctcaacgaggccgtcatggccgtgggcatggtcagcatcctggcctccagcctgctcaagaacgacatccccatgaccgggcccctggtggcgggcgggctgctcacggtgtgctacgtcctgaccggccggagcgccgacctggagctcgagaaggccgccgacgtgaagtgggaggaccaggccgagatctccgggagctcccccatcctgagcatcaccatctccgaggacggcagcatgtccatcaagaacgaggaggaggagcacaccctgacgatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggggaaggccgagctggaggacggcgcgtaccgcatcaagcagcgggggatcttcggctactcccagatcggcgccggggtctacaaggagggcaccttccacaccatgtggcacgtgacgcgcggggccgtgctcatgcaccggggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagaccaagcccggcctgttcaagaccaacaccgggacgatcggcgccgtgagcctcgacttctcccccggcaccagcgggtcccccatcgtggaccgcaagggcaaggtcgtggggctgtacggcaacggcgtggtcacccggagcggggcctacgtgtccgccatcgcgcagaccgagaagtccatcgaggacaaccccgagatcgaggacgacatcttccgcaagaagcggctgacgatcatggacctccaccccggcgccgggaagaccaagcgctacctgcccgccatcgtgcgggaggccatcaagcgcggcctgcggaccctgatcctcgccccgacccgcgtcgtggcggccgagatggaggaggccctgcgcgggctgcccatccggtaccagacgcccgccatccgcgccgagcacaccggccgggagatcgtggacctcatgtgccacgcgaccttcaccatgcgcctgctgagccccgtccgggtgccgaactacaacctcatcatcatggacgaggcccacttcacggaccccgcctccatcgccgcccgcggctacatcagcacccgggtggagatgggggaggcggccggcatcttcatgaccgccacgccgcccgggtcccgcgacccgttcccccagagcaacgcccccatcatggacgaggagcgggagatccccgagcgctcctggaacagcggccacgagtgggtcacggacttcaaggggaagaccgtgtggttcgtgccgtccatcaaggcgggcaacgacatcgccgcctgcctgcggaagaacggcaagaaggtcatccagctgagccgcaagaccttcgactccgagtacgtgaagacccgggccaacgactgggacttcgtggtcacgaccgacatcagcgagatgggggccaacttccgcgcggagcgggtgatcgacccccgccggtgcatgaagcccgtgatcctcaccgacggcgaggagcgcgtcatcctggccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctcctggacaacatcaacacgcccgagggcatcatcccgtccatgttcgagcccgagcgcgagaaggtggacgccatcgacggggagtaccggctgcgcggcgaggcccggaagaccttcgtcgacctcatgcgccgcggggacctgcccgtgtggctggcctaccgcgtggccgcggagggcatcaactacgccgaccggcgctggtgcttcgacgggatcaagaacaaccagatcctcgaggagaacgtcgaggtggagatctggaccaaggagggcgagcggaagaagctgaagccgcgctggctggacgcccggatctacagcgaccccctcgccctgaaggagttcaaggagttcgcggccggccgcaagtccctgaccctcaacctgatcacggagatggggcggctgcccaccttcatgacccagaaggcccgcgacgccctcgacaacctggccgtgctgcacaccgcggaggtcggcgggcgggcctacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcgcagatccagccgcactggatcgccgcctccatcatcctggagttcttcctcatcgtcctgctgatccccgagcccgagaagcagcgcacgccccaggacaaccagctcacctacgtggtgatcgccatcctgacggtcgtggccgcgaccatggccaacgagatggggttcctggagaagaccaagaaggacctcggcctgggcagcatcaccacgcaggagagcgagtccaacatcctggacatcgacctccggccggccagcgcctggaccctgtacgccgtggcgaccaccttcgtcacgcccatgctgcgccactccatcgagaacagctccgtgaacgtgagcctcaccgccatcgccaaccaggccaccgtcctgatggggctgggccgggggtggcccctctccaagatggacatcggcgtgcccctgctggcgatcgggtgctacagccaggtgaacccgatcaccctcacggccgccctgctgctcctggtcgcccactacgccatcatcggccccggcctgcaggcgaaggccacccgcgaggcccagaagcgcaccgccgccgggatcatgaagaaccccaccgtggacggcatcacggtgatcgacctcgagcccatcccgtacgaccccaagttcgagaagcagctggggcaggtcatgctgctcgtgctgtgcgtgacccaggtcctgatgatgcggaccacctgggcgctctgcgaggccctgacgctggccaccggccccatctccaccctctgggaggggaaccccggccgcttctggaacaccacgatcgccgtgagcatggccaacatcttccggggctcctacctggcgggggccggcctcctcttcagcatcatgaagaacaccaccaacacccgccgggggacgggcaacatcggcgagaccctgggggagaagtggaagtcccgcctgaacgccctcggcaagagcgagttccagatctacaagaagtccgggatccaggaggtggaccggaccctggccaaggagggcatcaagcgcggggagaccgaccaccacgcggtcagccggggctccgccaagctgcgctggttcgtggagcggaacatggtgacgccggagggcaaggtcgtggacctcgggtgcggccgcgggggctggagctactactgcgggggcctgaagaacgtgcgggaggtcaagggcctgaccaagggcgggcccgggcacgaggagcccatccccatgtccacctacggctggaacctcgtgcgcctgcagagcggggtggacgtcttcttcaccccgcccgagaagtgcgacacgctgctctgcgacatcggcgagagctcccccaaccccaccatcgaggccggccggaccctgcgcgtgctgaacctcgtggagaactggctgaacaacaacacccagttctgcgtcaaggtgctgaacccgtacatgcccagcgtgatcgagaagatggagaccctccagcggaagtacgggggcgccctggtccgcaaccccctgtcccggaacagcacgcacgagatgtactgggtgtccaacgccaccgggaacatcgtgagctccgtcaacatgatcagccgcatgctgatcaaccgcttcaccatgaagcacaagaaggcgacctacgagccggacgtggacctcggctccgggacgcggaacatcggcatcgagaacgagatccccaacctggacatcatcggcaagcgcatcgagaagatcaagcaggagcacgagaccagctggcactacgaccaggaccacccctacaagacctgggcctaccacgggtcctacgagaccaagcagacgggcagcgcctccagcatggtgaacggggtcgtgaagctgctcaccaagccctgggacgtggtcccgatggtgacccagatggccatgaccgacacgacccccttcggccagcagcgggtgttcaaggagaaggtcgacacccgcacccaggagcccaaggagggcacgaagaagctgatgcggatcaccgccgagtggctgtggaaggagctcgggaagaagaagacgccccgcatgtgcacccgggaggagttcacgcgcaaggtgcggtccaacgcggccctgggcgccatcttcaccgacgagaacaagtggaagtccgcccgcgaggccgtggaggactcccggttctgggagctggtcgaccgcgagcggaacctccacctggaggggaagtgcgagacctgcgtgtacaacatgatgggcaagcgcgagaagaagctgggggagttcggcaaggcgaagggcagccgggccatctggtacatgtggctcggggcccgcttcctggagttcgaggccctgggcttcctcaacgaggaccactggttctcccgggggaacagcctgagcggcgtcgagggggagggcctgcacaagctcggctacatcctgcgcgacgtgtccaagaaggagggcggggcgatgtacgccgacgacaccgccgggtgggacacgcggatcaccctggaggacctcaagaacgaggagatggtgaccaaccacatgaagggcgagcacaagaagctggccgaggccatcttcaagctgacctaccagaacaaggtcgtgcgcgtgcagcggccgacgccccgcgggaccgtcatggacatcatcagccgcaaggaccagcggggctccggccaggtggggacctacggcctcaacaccttcacgaacatggaggcgcagctgatccgccagatggagggggagggcatcttcaagagcatccagcggctgaccgtgaccgaggagatcgccgtccagaactggctcgcccgcgtgggccgggagcgcctgtcccggatggccatcagcggggacgactgcgtggtcaagcccctggacgaccgcttcgcctccgcgctcaccgccctgaacgacatgggcaaggtgcggaaggacatccagcagtgggagcccagccgcgggtggaacgactggacccaggtgccgttctgctcccaccacttccacgagctggtcatgaaggacggccggatgctcgtggtgccctgccgcaaccaggacgagctgatcgggcgggcccgcatcagccagggcgccggctggtccctgaaggagaccgcctgcctcggcaagagctacgcgcagatgtggaccctgatgtacttccaccggcgcgacctgcggctcgccgccaacgccatctgctccgccgtccccagccactgggtgcccacctcccgcaccacgtggagcatccacgcgaagcacgagtggatgaccaccgaggacatgctggccgtgtggaaccgggtctggatccaggagaacccgtggatggaggacaagacccccgtggagtcctgggaggaggtgccctacctgggcaagcgcgaggaccagtggtgcgggagcctcatcggcctgacgagccgcgccacctgggccaagaacatccagaccgcgatcaaccaggtccggtccctgatcgggaacgaggagtacaccgactacatgcccagcatgaagcgcttccggaaggaggaggaggaggccggcgtgctctggtga

SEQ ID NO: 9324 - RNA, 9876 nt, synthetic construct
  misc_feature 1..9876: note = derived and/or modified CDS sequence (opt1) from DENV-2__KF955360__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcgccaccaccggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggcggccatcctggcctacaccatcgggaccacccacttccagcgggccctcatcttcatcctgctgacggcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctgttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggacaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggtgatggtccaggcggactccggctgcgtggtgagctggaagaacaaggagctgaagtgcggctccgggatcttcatcaccgacaacgtccacacctggacggagcagtacaagttccagcccgagagccccagcaagctggcctccgccatccagaaggcccacgaggagggcatctgcgggatccggagcgtgacccgcctcgagaacctgatgtggaagcagatcacccccgagctgaaccacatcctctccgagaacgaggtgaagctgaccatcatgacgggcgacatcaaggggatcatgcaggccggcaagcggagcctgcgcccgcagcccaccgagctcaagtactcctggaagacctggggcaaggcgaagatgctgagcaccgagtcccacaaccagacgttcctgatcgacgggcccgagaccgccgagtgcccgaacaccaaccgggcctggaacagcctcgaggtcgaggactacggcttcggggtgttctccaccaacatctggctgaagctgcgcgagaagcaggacgtgttctgcgacagcaagctcatgtccgccgccatcaaggacaaccgggcggtccacgccgacatgggctactggatcgagagcgccctgaacgacacgtggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagaccgcggggccctggcacctgggcaagctggagatggacttcgacttctgcgaggggaccacggtcgtggtgaccgaggactgcggcaaccggggccccagcctccgcaccaccacggcctccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgaccgccgggcacggccagatcgacaacttcagcctgggcgtgctggggatggccctcttcctggaggagatgctgcggacgcgcgtcggcaccaagcacgcgatcctcctggtggccgtgtccttcgtcaccctgatcaccgggaacatgagcttccgggacctcggccgcgtgatggtgatggtcggggccacgatgaccgacgacatcggcatgggcgtgacctacctggccctgctcgccgcgttcaaggtgcgccccaccttcgccgccgggctgctgctccggaagctgacgtccaaggagctgatgatggccaccatcggcatcgccctcctgagccagtccaccatccccgagaccatcctggagctcacggacgcgctggccctggggatgatggtcctcaagatcgtgcgcaacatggagaagtaccagctggccgtgaccatcatggccatcagctgcgtcccgaacgccgtgatcctgcagaacgcgtggaaggtgtcctgcaccatcctcgccgccgtcagcgtgagccccctgctgctcaccagctcccagcagaaggccgactggatccccctggcgctgacgatcaagggcctcaaccccaccgccatcttcctgaccaccctgagccggacgtccaagaagcgcagctggccgctcaacgaggccgtcatggccgtgggcatggtgtccatcctggccagcagcctgctcaagaacgacatccccatgaccgggcccctggtcgcgggcgggctgctcaccgtgtgctacgtgctgaccggccggtccgccgacctggagctcgagcgcgccgccgacgtcaagtgggaggaccaggccgagatcagcgggtccagccccatcctgtccatcacgatcagcgaggacggctccatgagcatcaagaacgaggaggaggagcacaccctgaccatcctcatccggaccggcctgctggtgatctccggggtgttcccggtcagcatccccatcacggcggccgcctggtacctctgggaggtgaagaagcagcgcgccggcgtgctgtgggacgtccccagcccgccgcccgtggggaaggccgagctggaggacggcgcgtaccggatcaagcagcgcgggatcttcggctacagccagatcggcgccggggtgtacaaggagggcaccttccacaccatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgcggtgcagaccaagcccggcctgttcaagacgaacaccgggaccatcggcgccgtctccctcgacttcagccccggcacctccgggagccccatcgtggaccggaagggcaaggtggtcgggctgtacggcaacggcgtggtgacgcgctccggggcctacgtcagcgccatcgcgcagaccgagaagtccatcgaggacaaccccgagatcgaggacgacatcttccggaagaagcgcctgaccatcatggacctccaccccggcgccgggaagaccaagcggtacctgcccgccatcgtgcgcgaggccatcaagcggggcctgcgcacgctgatcctcgccccgacccgcgtggtcgcggccgagatggaggaggccctgcgggggctgcccatccgctaccagacccccgccatccgggccgagcacaccggccgcgagatcgtggacctcatgtgccacgcgacgttcaccatgcggctgctgtcccccgtgcgcgtcccgaactacaacctcatcatcatggacgaggcccacttcaccgaccccgccagcatcgccgcccggggctacatctccacccgcgtggagatgggggaggcggccggcatcttcatgacggccacgccgcccgggagccgggacccgttcccccagtccaacgcccccatcatggacgaggagcgcgagatccccgagcggagctggaactccggccacgagtgggtgaccgacttcaaggggaagaccgtctggttcgtgccgagcatcaaggcgggcaacgacatcgccgcctgcctgcgcaagaacggcaagaaggtgatccagctgtcccggaagacgttcgacagcgagtacgtcaagacccgcgccaacgactgggacttcgtggtgaccaccgacatctccgagatgggggccaacttccgggcggagcgcgtcatcgacccccggcgctgcatgaagcccgtgatcctcacggacggcgaggagcgggtgatcctggccgggcccatgccggtcacccacagctccgccgcccagcgccgcggccggatcgggcgcaaccccaagaacgagaacgaccagtacatctacatgggcgagcccctggagaacgacgaggactgcgcccactggaaggaggcgaagatgctcctggacaacatcaacacccccgagggcatcatcccgagcatgttcgagcccgagcgggagaaggtggacgccatcgacggggagtaccgcctgcggggcgaggcccgcaagaccttcgtggacctcatgcggcgcggggacctgcccgtctggctggcctaccgggtggccgcggagggcatcaactacgccgaccgccggtggtgcttcgacgggatcaagaacaaccagatcctcgaggagaacgtggaggtcgagatctggacgaaggagggcgagcgcaagaagctgaagccgcggtggctggacgcccgcatctactccgaccccctcgccctgaaggagttcaaggagttcgcggccggccggaagtccctgaccctcaacctgatcaccgagatggggcgcctgcccaccttcatgacgcagaaggcccgggacgccctcgacaacctggccgtgctgcacaccgcggaggtcggcgggcgcgcctacaaccacgccctctccgagctgcccgagaccctggagaccctcctgctgctcacgctgctggccaccgtgaccggcggcatcttcctcttcctgatgagcgggaagggcatcgggaagatgaccctgggcatgtgctgcatcatcacggcctccatcctcctgtggtacgcgcagatccagccgcactggatcgccgccagcatcatcctggagttcttcctcatcgtgctgctgatccccgagcccgagaagcagcggacgccccaggacaaccagctcacctacgtcgtgatcgccatcctgaccgtggtcgccgcgaccatggccaacgagatggggttcctggagaagacgaagaaggacctcggcctgggcagcatcaccacccaggagtccgagagcaacatcctggacatcgacctccgcccggcctccgcctggaccctgtacgccgtggcgacgaccttcgtgacccccatgctgcggcacagcatcgagaactccagcgtcaacgtgtccctcaccgccatcgccaaccaggccacggtgctgatggggctgggccgcgggtggcccctcagcaagatggacatcggcgtccccctgctggcgatcgggtgctactcccaggtgaacccgatcaccctcaccgccgccctgctgctcctggtggcccactacgccatcatcggccccggcctgcaggcgaaggccacccgcgaggcccagaagcggacggccgccgggatcatgaagaaccccaccgtcgacggcatcaccgtgatcgacctcgagcccatcccgtacgaccccaagttcgagaagcagctgggccaggtgatgctgctcgtcctgtgcgtgacccaggtgctgatgatgcgcacgacctgggcgctctgcgaggccctgaccctggccaccggccccatcagcacgctctgggaggggaaccccggccggttctggaacaccaccatcgccgtctccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtgtcccgcggcagcgccaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgaccaagggcgggcccgggcacgaggagcccatccccatgagcacgtacggctggaacctcgtccggctgcagagcggggtggacgtgttcttcaccccgcccgagaagtgcgacaccctgctctgcgacatcggcgagtccagccccaaccccaccatcgaggccggccgcacgctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccaccgggaacatcgtctccagcgtgaacatgatctcccgcatgctgatcaaccggttcacgatgaagcacaagaaggcgacctacgagccggacgtggacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtcaacggggtggtgaagctgctcaccaagccctgggacgtcgtgccgatggtgacgcagatggccatgaccgacaccacccccttcggccagcagcgcgtcttcaaggagaaggtggacacgcggacccaggagcccaaggagggcaccaagaagctgatgcgcatcaccgccgagtggctgtggaaggagctcgggaagaagaagacgccccggatgtgcacccgcgaggagttcacccggaaggtgcgcagcaacgcggccctgggcgccatcttcaccgacgagaacaagtggaagtccgcccgggaggccgtcgaggacagccgcttctgggagctggtggaccgggagcgcaacctccacctggaggggaagtgcgagacgtgcgtctacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtgagcaagaaggagggcggggcgatgtacgccgacgacaccgccgggtgggacacccgcatcaccctggaggacctcaagaacgaggagatggtcacgaaccacatgaagggcgagcacaagaagctggccgaggccatcttcaagctgacctaccagaacaaggtggtgcgggtccagcgcccgacgccccgggggaccgtgatggacatcatctcccggaaggaccagcgcggcagcggccaggtggggacgtacggcctcaacaccttcaccaacatggaggcgcagctgatccggcagatggagggggagggcatcttcaagtccatccagcgcctgaccgtcacggaggagatcgccgtgcagaactggctcgcccgggtgggccgcgagcggctgagccgcatggccatctccggggacgactgcgtcgtgaagcccctggacgaccggttcgccagcgcgctcaccgccctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcgggcgcgcccggatctcccagggcgccggctggagcctgaaggagaccgcctgcctcgggaagtcctacgcgcagatgtggacgctgatgtacttccaccgccgggacctgcgcctcgccgccaacgccatctgcagcgccgtgccctcccactgggtccccaccagccggaccacctggtccatccacgcgaagcacgagtggatgaccacggaggacatgctggccgtgtggaaccgcgtgtggatccaggagaacccgtggatggaggacaagacccccgtcgagagctgggaggaggtgccctacctgggcaagcgcgaggaccagtggtgcgggagcctcatcggcctgacctcccgggccacctgggccaagaacatccagacggcgatcaaccaggtgcgcagcctgatcgggaacgaggagtacaccgactacatgccctccatgaagcggttccgcaaggaggaggaggaggccggcgtcctctggtga

SEQ ID NO: 9325 - RNA, 9876 nt, synthetic construct
  misc_feature 1..9876: note = derived and/or modified CDS sequence (opt1) from DENV-2__KF955363__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctcgagaacctgatgtggaagcaggtcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggcgaagatgctgagcacggagtcccacaaccagaccttcctgatcgacgggcccgagaccgccgagtgcccgaacaccaaccgggcctggaacagcctcgaggtcgaggactacggcttcggggtgttcacgaccaacatctggctgaagctgcgcgagaagcaggacgtgttctgcgactccaagctcatgagcgccgccatcaaggacaaccgggcggtccacgccgacatgggctactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgccgggcccgtctcccagcacaactaccgcccgggctaccacacccagacggcggggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcgtgggcaccaagcacgcgatcctcctggtggccgtcagcttcgtgacgctgatcaccgggaacatgtccttccgggacctcggccgcgtgatggtcatggtgggggccaccatgaccgacgacatcggcatgggcgtgacgtacctggccctgctcgccgcgttcaaggtccgccccaccttcgccgccgggctgctgctccggaagctgaccagcaaggagctgatgatggccaccatcggcatcgccctcctgtcccagagcacgatccccgagaccatcctggagctcaccgacgcgctggccctggggatgatggtgctcaagatcgtgcgcaacatggagaagtaccagctggccgtcaccatcatggccatctcctgcgtgccgaacgccgtgatcctgcagaacgcgtggaaggtcagctgcacgatcctcgccgccgtgtccgtcagccccctgctgctcacctccagccagcagaaggccgactggatccccctggcgctgaccatcaagggcctcaaccccaccgccatcttcctgacgaccctgtcccggaccagcaagaagcgctcctggccgctcaacgaggccatcatggccgtgggcatggtgagcatcctggcctccagcctgctcaagaacgacatccccatgaccgggcccctggtcgcgggcgggctgctcacggtgtgctacgtgctgaccggccggagcgccgacctggagctcgagcgcgccgccgacgtcaagtgggaggaccaggccgagatctccgggagctcccccatcctgagcatcaccatctccgaggacggcagcatgtccatcaagaacgaggaggaggagcagaccctgacgatcctcatccggaccggcctgctggtgatcagcggggtgttcccggtctccatccccatcaccgcggccgcctggtacctctgggaggtgaagaagcagcgcgccggcgtgctgtgggacgtccccagcccgccgcccgtggggaaggccgagctggaggacggcgcgtaccggatcaagcagcgcgggatcctcggctactcccagatcggcgccggggtgtacaaggagggcaccttccacaccatgtggcacgtcacgcgcggggccgtgctgatgcaccgcggcaagcggatcgagcccagctgggccgacgtgaagaaggacctgatctcctacgggggcggctggaagctcgagggggagtggaaggagggcgaggaggtccaggtgctggccctggagcccgggaagaacccccgcgcggtgcagaccaagcccggcctcttcaagaccaacaccgggacgatcggcgccgtcagcctggacttctcccccggcaccagcgggtcccccatcgtggaccggaagggcaaggtggtcgggctgtacggcaacggcgtggtgacccgcagcggggcctacgtctccgccatcgcgcagaccgagaagtccatcgaggacaaccccgagatcgaggacgacatcttccggaagaagcgcctcacgatcatggacctgcaccccggcgccgggaagaccaagcggtacctgcccgccatcgtgcgcgaggccatcaagcggggcctgcgcaccctcatcctggccccgacccgcgtggtcgcggccgagatggaggaggccctgcgggggctccccatccgctaccagacgcccgccatccgggccgagcacaccggccgcgagatcgtggacctgatgtgccacgcgaccttcaccatgcggctgctcagccccgtgcgcgtcccgaactacaacctgatcatcatggacgaggcccacttcacggaccccgcctccatcgccgcccggggctacatcagcacccgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggcgggcaacgacatcgccgcctgcctgcgcaagaacggcaagaaggtgatccagctcagccggaagaccttcgactccgagtacgtcaagacccgcgccaacgactgggacttcgtggtgacgaccgacatcagcgagatgggggccaacttcaaggcggagcgggtcatcgacccccgccggtgcatgaagcccgtgatcctgaccgacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacgcccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctaccgcgtggccgcggagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctacagcgaccccctggccctgaaggagttcaaggagttcgcggccggccgcaagtccctcaccctgaacctgatcacggagatggggcggctccccaccttcatgacccagaaggcccgcgacgccctggacaacctggccgtgctccacaccgcggaggccggcgggaaggcctacaaccacgccctgagcgagctgcccgagacgctcgagaccctgctgctcctgaccctgctcgccaccgtcacgggcggcatcttcctgttcctgatgtccgggaagggcatcgggaagatgaccctcggcatgtgctgcatcatcaccgcgagcatcctgctgtggtacgcccagatccagccgcactggatcgccgcctccatcatcctcgagttcttcctgatcgtgctgctcatccccgagcccgagaagcagcggacgccccaggacaaccagctgacctacgtggtcatcgccatcctgacggtggtggcggccaccatggccaacgagatggggttcctcgagaagaccaagaaggacctgggcctgggcagcatcaccacgcaggagagcgagtccaacatcctcgacatcgacctgcgcccggccagcgcctggaccctgtacgcggtcgccaccaccttcgtgacgcccatgctccggcactccatcgagaacagctccgtgaacgtcagcctgaccgccatcgccaaccaggcgaccgtgctgatggggctcggcaaggggtggcccctgtccaagatggacatcggcgtgcccctgctcgccatcgggtgctacagccaggtcaacccgatcaccctgacggccgccctgctcctgctggtggcccactacgcgatcatcggccccggcctccaggccaaggccacccgcgaggcccagaagcgggccgcggccgggatcatgaagaaccccaccgtggacggcatcaccgtcatcgacctggagcccatcccgtacgaccccaagttcgagaagcagctgggccaggtgatgctcctgatcctgtgcgtgacgcaggtcctcatgatgcgcaccacctgggccctgtgcgaggccctgaccctcgccacgggccccatctccaccctgtgggaggggaaccccggccgcttctggaacaccaccatcgcggtgagcatggccaacatcttccggggctcctacctggccggggccggcctcctgttcagcatcatgaagaacacgaccaacacccgccgggggaccggcaacatcggcgagacgctgggggagaagtggaagtcccgcctcaacgcgctgggcaagagcgagttccagatctacaagaagtccgggatccaggaggtggaccggaccctggccaaggagggcatcaagcgcggggagaccgaccaccacgccgtcagccggggctccgccaagctccgctggttcgtggagcggaacatggtgaccccggagggcaaggtcgtggacctggggtgcggccgcgggggctggagctactactgcgggggcctgaagaacgtgcgggaggtcaagggcctcacgaagggcgggcccgggcacgaggagcccatccccatgtccacctacggctggaacctggtgcgcctgcagagcggggtggacgtcttcttcaccccgcccgagaagtgcgacaccctcctgtgcgacatcggcgagagctcccccaaccccacgatcgaggccggccggaccctgcgcgtgctcaacctggtggagaactggctgaacaacaacacccagttctgcatcaaggtcctcaacccgtacatgcccagcgtgatcgagaagatggagaccctgcagcggaagtacgggggcgcgctggtgcgcaaccccctgtcccggaacagcacccacgagatgtactgggtctccaacgccacggggaacatcgtgagctccgtgaacatgatcagccgcatgctcatcaaccggttcaccatgaagcacaagaaggccacctacgagccggacgtcgacctgggctccgggacccgcaacatcggcatcgagagcgagatccccaacctggacatcatcggcaagcgcatcgagaagatcaagcaggagcacgagacgtcctggcactacgaccaggaccacccctacaagacctgggcctaccacgggagctacgagaccaagcagaccggctccgccagctccatggtgaacggggtggtccggctcctgacgaagccctgggacgtggtgccgatggtcacccagatggcgatgaccgacaccacgcccttcggccagcagcgcgtgttcaaggagaaggtggacacccggacccaggagcccaaggagggcaccaagaagctgatgaagatcacggccgagtggctctggaaggagctggggaagaagaagacgccccggatgtgcacccgggaggagttcacccgcaaggtccggagcaacgccgccctgggcgccatcttcacggacgagaacaagtggaagtccgcgcgcgaggccgtggaggacagccggttctgggagctcgtggaccgcgagcggaacctgcacctggaggggaagtgcgagacctgcgtctacaacatgatgggcaagcgcgagaagaagctcggggagttcggcaaggccaagggctcccgggccatctggtacatgtggctgggggcgcgcttcctggagttcgaggccctcggcttcctgaacgaggaccactggttcagccgggggaacagcctgtccggcgtggagggggagggcctccaccgcctgggctacatcctgcgggacgtcagcaagaaggagggcggggccatgtacgccgacgacaccgccgggtgggacacccgcatcacgctcgaggacctgaagaacgaggagatggtgaccaaccacatgaagggcgagcacaagaagctggcggaggccatcttcaagctcacctaccagaacaaggtggtccgggtgcagcgcccgacgccccgggggacggtgatggacatcatctcccgccgcgaccagcggggcagcggccaggtcgggacctacggcctgaacaccttcaccaacatggaggcccagctgatccgccagatggagggggagggcatcttcaagtccatccagcacctcacggtgaccgaggagatcgccgtgcagaactggctggcccgggtcggccgcgagcggctgagccgcatggtgatctccggggacgactgcgtggtcaagcccctcgacgaccggttcgcgagcgccctgaccgccctgaacgacatgggcaaggtgcgcaaggacatccagcagtgggagccctcccgggggtggaacgactggacccaggtgccgttctgcagccaccacttccacgagctcgtcatgaaggacggccgcgtgctggtggtcccctgccggaaccaggacgagctgatcgggcgcgcccggatctcccagggcgccggctggagcctcaaggagacggcgtgcctggggaagtcctacgcccagatgtggaccctgatgtacttccaccgccgggacctccgcctggccgccaacgccatctgcagcgcggtgccctcccactgggtgcccaccagccggaccacctggtccatccacgccaagcacgagtggatgacgaccgaggacatgctggccgtctggaaccgcgtgtggatccaggagaacccgtggatggaggacaagacccccgtggagagctgggaggaggtcccctacctcggcaagcgggaggaccagtggtgcgggagcctgatcggcctgacctcccgcgccacgtgggcgaagaacatccagaccgccatcaaccaggtgcgcagcctcatcgggaacgaggagtacaccgactacatgccctccatgaagcggttccgccgggaggaggaggaggccggcgtgctgtggtga

SEQ ID NO: 9326 - RNA, 9876 nt, synthetic construct
  misc_feature 1..9876: note = derived and/or modified CDS sequence (opt1) from DENV-2__EU726767__SS-prME
  source 1..9876: mol_type = other RNA
agcgcgggcatgatcatcatgctgatccccaccgtgatggccttccacctcaccacccgcaacggggagccccacatgatcgtgtcccggcaggagaagggcaagagcctgctgttcaagaccgaggacggggtgaacatgtgcaccctcatggcgatggacctgggcgagctgtgcgaggacaccatcacctacaagtgccccctcctgcgccagaacgagcccgaggacatcgactgctggtgcaactccaccagcacctgggtgacctacgggacgtgcgccaccaccggcgagcaccggcgcgagaagcggtccgtggccctggtgccccacgtgggcatggggctcgagacccgcacggagacctggatgagctccgagggcgcctggaagcacgcccagcggatcgagacctggatcctgcgccacccggggttcaccatcatggcggccatcctggcctacacgatcggcaccacccacttccagcgggccctcatcttcatcctgctgaccgcggtcgcccccagcatgacgatgcgctgcatcgggatctccaaccgggacttcgtggagggcgtgagcggcgggtcctgggtcgacatcgtgctcgagcacggcagctgcgtgaccaccatggccaagaacaagcccaccctggacttcgagctgatcaagacggaggccaagcagcccgccaccctccgcaagtactgcatcgaggcgaagctgaccaacaccacgaccgagtcccggtgccccacccagggggagcccagcctgaaggaggagcaggacaagcgcttcgtctgcaagcactccatggtggaccggggctggggcaacgggtgcggcctcttcgggaagggcgggatcgtgacctgcgccatgttcacgtgcaagaagaacatggagggcaagatcgtccagcccgagaacctggagtacaccatcgtggtgacgccccacagcggcgaggagcacgccgtcgggaacgacaccggcaagcacgggaaggagatcaaggtgacgccgcagtccagcatcaccgaggccgagctgaccggctacgggaccgtgaccatggagtgcagcccccgcacgggcctcgacttcaacgagatggtcctgctgcagatggagaacaaggcctggctcgtgcaccggcagtggttcctggacctgcccctcccctggctgccgggcgcggacacccaggggagcaactggatccagaaggagaccctggtgaccttcaagaacccccacgccaagaagcaggacgtcgtggtcctcggcagccaggagggggccatgcacacggccctgaccggcgccaccgagatccagatgtccagcgggaacctcctgttcaccggccacctgaagtgccgcctgcggatggacaagctccagctgaagggcatgtcctacagcatgtgcacggggaagttcaaggtggtgaaggagatcgcggagacccagcacggcaccatcgtcatccgcgtgcagtacgagggggacggctccccctgcaagatccccttcgagatcatggacctggagaagcggtacgtgctcggccgcctgatcaccgtcaacccgatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcgcggcgccaagcggatggccatcctgggcgacaccgcctgggacttcgggagcctgggcggggtgttcacgtccatcggcaaggcgctccaccaggtgttcggggccatctacggcgccgccttcagcggcgtctcctggaccatgaagatcctgatcggggtgatcatcacctggatcggcatgaacagccgctccaccagcctgtccgtgagcctggtcctcgtggggatcgtgacgctgtacctgggcgtcatggtgcaggcggactccgggtgcgtggtcagctggaagaacaaggagctcaagtgcggcagcggcatcttcatcaccgacaacgtgcacacctggaccgagcagtacaagttccagcccgagtcccccagcaagctggcctccgccatccagaaggcccaggaggaggggatctgcggcatccggagcgtgacgcgcctggagaacctcatgtggaagcagatcacccccgagctgaaccacatcctggccgagaacgaggtcaagctcaccatcatgaccggggacgtgaagggcatcatgcaggcggggaagcggtccctgcgcccgcagcccacggagctgaagtacagctggaagacctggggcaaggccaagatgctctccaccgagagccacaaccagaccttcctgatcgacggccccgagacggccgagtgcccgaacaccaaccgggcctggaactccctggaggtggaggactacgggttcggcgtcttcaccaccaacatctggctcaagctgaaggagaagcaggacgccttctgcgacagcaagctgatgtccgcggccatcaaggacaaccgcgccgtgcacgccgacatggggtactggatcgagagcgccctcaacgacacgtggaagatcgagaaggcgtccttcatcgaggtgaagaactgccactggcccaagagccacaccctgtggtccaacggcgtcctggagagcgagatgatcatccccaagaacctcgccggccccgtgtcccagcacaactaccggccggggtaccacacccagatcgccggcccctggcacctggggaagctggagatggacttcgacttctgcgagggcaccaccgtggtcgtgacggaggactgcgggaaccgcggccccagcctccggaccaccaccgccagcggcaagctgatcacggagtggtgctgccgctcctgcaccctgcccccgctccggtaccgcggggaggacggctgctggtacgggatggagatccggcccctgaaggagaaggaggagaacctggtgaacagcctcgtcaccgcgggccacggccaggtggacaacttctccctgggcgtgctgggcatggccctcttcctggaggagatgctgcgcacccgggtcgggacgaagcacgccatcctcctggtggccgtgagcttcatgaccctgatcaccggcaacatgtccttcaaggacctcgggcgcgtcgtggtgatggtcggcgccgcgatgaccgacgacatcgggatgggcgtgacgtacctggccctgctcgccgccttcaaggtgcggcccaccttcgccgcgggcctgctgctccgcaagctgaccagcaaggagctgatgatgaccacgatcgggatcgccctcctgtcccagagcaccatccccgagaccatcctggagctcaccgacgccctggccctgggcatgatggtcctcaagatggtgcgcaacatggagaagtaccagctggccgtgacgatcatggcgatcctgtgcgtcccgaacgccgtgatcctccagaacgcctggaaggtctcctgcaccatcctggccgtggtgagcgtcagccccctgctcctgaccagctcccagcagaagaccgactggatccccctggcgctcacgatcaaggggctgaaccccaccgccatcttcctgaccaccctcagccggacgtccaagaagcgcagctggccgctgaacgaggccatcatggccgtgggcatggtgtccatcctggccagctccctcctgaagaacgacatccccatgaccggccccctggtcgccggcgggctcctgaccgtgtgctacgtgctgaccgggcggagcgccgacctcgagctggagcgcgccacggacgtcaagtgggaggaccaggccgagatcagcgggtccagccccatcctgtccatcaccatcagcgaggacgggtccatgagcatcaagaacgaggaggaggagcagaccctcaccatcctgatccggacgggcctgctcgtgatctccggcctgttcccggtgagcatccccatcaccgccgcggcctggtacctgtgggaggtcaagaagcagcgcgccggggtgctctgggacgtgcccagcccgccgcccatgggcaaggccgagctggaggacggggcctaccggatcaagcagaagggcatcctggggtacagccagatcggcgcgggcgtctacaaggaggggaccttccacaccatgtggcacgtgacccgcggcgccgtgctcatgcacaaggggaagcggatcgagccctcctgggccgacgtcaagaaggacctgatcagctacggcgggggctggaagctggagggcgagtggaaggagggggaggaggtccaggtgctcgccctggagcccggcaagaacccccgcgccgtccagacgaagcccgggctgttcaagaccaacgcgggcaccatcggggccgtgtccctcgacttcagccccggcacctccggcagccccatcatcgacaagaaggggaaggtggtcggcctgtacgggaacggcgtggtgacgcggtccggcgcctacgtcagcgccatcgcgcagaccgagaagtccatcgaggacaaccccgagatcgaggacgacatcttccgcaagcggcgcctgaccatcatggacctgcaccccggggccggcaagaccaagcggtacctccccgccatcgtgcgcgaggccatcaagcgggggctgcgcacgctgatcctcgccccgacccgggtggtcgcggccgagatggaggaggccctgcgcggcctgcccatccggtaccagacccccgccatccgcgccgagcacaccgggcgcgagatcgtggacctcatgtgccacgcgacgttcaccatgcggctgctgagccccgtgcgcgtcccgaactacaacctcatcatcatggacgaggcccacttcaccgaccccgccagcatcgccgcccggggctacatctccacccgcgtggagatgggcgaggcggccgggatcttcatgacggccacgccgcccggcagccgggacccgttcccccagtccaacgcccccatcatcgacgaggagcgcgagatccccgagcggagctggaactccgggcacgagtgggtgaccgacttcaagggcaagaccgtctggttcgtgccgagcatcaaggcggggaacgacatcgccgcctgcctgcgcaagaacggcaagaaggtgatccagctgtcccggaagacgttcgacagcgagtacgtcaagacccgcaccaacgactgggacttcgtggtgaccacggacatctccgagatgggcgccaacttcaaggccgagcgggtcatcgacccccgccggtgcatgaagcccgtgatcctcaccgacggggaggagcgcgtgatcctggcgggccccatgccggtcacccacagctccgccgcccagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgggagaaggtggacgcgatcgacggcgagtaccgcctgcgcggggaggcccggaagacgttcgtggacctcatgcgccggggcgacctgcccgtctggctggcctacaaggtggccgccgaggggatcaactacgcggaccgccggtggtgcttcgacggcatcaagaacaaccagatcctcgaggagaacgtggaggtcgagatctggaccaaggagggggagcgcaagaagctgaagccgcggtggctggacgcccgcatctactccgaccccctcgccctgaaggagttcaaggagttcgccgcgggccggaagtccctgaccctcaacctgatcaccgagatgggccgcctgcccacgttcatgacccagaagacccgggacgccctcgacaacctggccgtgctgcacaccgccgaggccgggggccgcgcgtacaaccacgccctctccgagctgcccgagacgctggagaccctcctgctgctcaccctgctggccaccgtcaccgggggcatcttcctcttcctgatgagcggccgggggatcggcaagatgaccctggggatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacctacgtggtcatcgccatcctgacggtggtggccgccaccatggcgaacgagatgggcttcctggagaagaccaagaaggacctcgggctgggctccatcgtcacccagcagccggagagcaacatcctggacatcgacctccggcccgccagcgcctggacgctgtacgccgtggccaccaccttcgtgacccccatgctgcgccactccatcgagaacagctccgtcaacgtgagcctcacggcgatcgccaaccaggccaccgtgctgatgggcctggggaagggctggcccctctccaagatggacatcggggtcccgctgctggccatcggctgctacagccaggtgaaccccatcaccctcaccgcggccctgctgctcctggtggcccactacgccatcatcgggcccggcctgcaggccaaggcgacgcgggaggcccagaagcgcgccgccgccggcatcatgaagaaccccaccgtcgacgggatcaccgtgatcgacctcgacccgatcccctacgaccccaagttcgagaagcagctgggccaggtgatgctgctcgtcctgtgcgtgacccaggtgctgatgatgcggacgacctgggcgctctgcgaggccctgaccctggccaccgggcccatctccacgctctgggagggcaacccggggcgcttctggaacaccaccatcgccgtcagcatggccaacatcttccggggctcctacctggcgggcgccgggctcctgttcagcatcatgaagaacaccacgaacacccgccgcggcaccgggaacatcggcgagaccctgggcgagaagtggaagtcccggctgaacgccctcgggaagtccgagttccagatctacaagaagtccggcatccaggaggtggaccgcacgctggccaaggaggggatcaagcggggcgagaccgaccaccacgcggtgagccgcgggtccgccaagctgcggtggttcgtcgagcgcaacatggtgacccccgagggcaaggtggtcgacctcggctgcgggcggggcgggtggagctactactgcggcgggctgaagaacgtgcgcgaggtgaagggcctgaccaagggcgggcccggccacgaggagcccatcccgatgtccacgtacgggtggaacctcgtccggctgcagagcggcgtggacgtgttcttcatcccgcccgagaagtgcgacaccctgctctgcgacatcggggagtccagccccaacccgaccgtcgaggccggccgcaccctgcgggtgctgaacctcgtggagaactggctgaacaacaacacgcagttctgcatcaaggtcctgaacccctacatgcccagcgtgatcgagaagatggaggccctgcagcgcaagtacggcggggccctcgtgcggaacccgctgtcccgcaacagcacccacgagatgtactgggtctccaacgcgagcggcaacatcgtgtccagcgtgaacatgatctcccggatgctgatcaaccgcttcaccatgcggcacaagaaggccacctacgagcccgacgtcgacctcgggagcggcacccgcaacatcgggatcgagtccgagatccccaacctggacatcatcggcaagcggatcgagaagatcaagcaggagcacgagacgagctggcactacgaccaggaccacccctacaagacctgggcctaccacggctcctacgagaccaagcagaccgggagcgcctccagcatggtgaacggcgtggtccgcctgctcacgaagccgtgggacgtgctgcccaccgtgacccagatggccatgaccgacacgacccccttcgggcagcagcgcgtcttcaaggagaaggtggacacccggacccaggagcccaaggagggcacgaagaagctgatgaagatcaccgcggagtggctctggaaggagctgggcaagaagaagaccccgcgcatgtgcacccgggaggagttcacgcgcaaggtgcggtccaacgccgccctgggggccgtcttcaccgacgagaacaagtggaagtccgcccgcgaggcggtggaggactcccggttctgggagctcgtcgacaaggagcgcagcctgcacctggagggcaagtgcgagacctgcgtgtacaacatgatggggaagcgggagaagaagctcggcgagttcgggaaggccaagggctcccgcgccatctggtacatgtggctgggcgcccggttcctggagttcgaggcgctcgggttcctgaacgaggaccactggttcagccgcgagaacagcctgtccggcgtggagggggagggcctccacaagctggggtacatcctgcgggacgtcagcaagaaggagggcggcgccatgtacgccgacgacaccgccgggtgggacacgcgcatcaccctcgaggacctgaagaacgaggagatggtgaccaaccacatggagggcgagcacaagaagctggccgaggcgatcttcaagctcacctaccagaacaaggtggtccgggtgcagcgccccacgccccgggggaccgtgatggacatcatctcccgccgggaccagcgcggcagcgggcaggtcggcacctacggcctgaacaccttcacgaacatggaggcccagctgatccggcagatggagggggagggcgtgttcaagaacatccagcacctcaccgtgaccgaggagatcgccgtccagaactggctggcccgcgtggggcgcgagcggctgtcccgcatggccatcagcggcgacgactgcgtggtcaagcccctcgacgaccggttcgcgtccgccctgaccgccctgaacgacatgggcaagatccgcaaggacatccagcagtgggagccgagccgggggtggaacgactggacgcaggtccccttctgctcccaccacttccacgagctcatcatgaaggacggccgcgtgctggtcgtgccctgccggaaccaggacgagctgatcgggcgcgcccggatcagccagggcgccgggtggtccctccgcgagaccgcgtgcctgggcaagagctacgcccagatgtggtccctgatgtacttccaccggcgcgacctccggctggccgccaacgccatctgcagcgcggtgccctcccactgggtcccgaccagccgcaccacgtggtccatccacgccaagcacgagtggatgaccaccgaggacatgctgaccgtgtggaaccgggtgtggatccaggagaacccctggatggaggacaagacccccgtcgagagctgggaggagatcccctacctcggcaagcgcgaggaccagtggtgcgggagcctgatcggcctgacgtcccgggccacctgggccaagaacatccaggcggccatcaaccaggtgcgcagcctcatcgggaacgaggagtacaccgactacatgccgtccatgaagcggttccgccgcgaggaggaggaggccggcgtgctgtggtga

SEQ ID NO: 9327 - RNA, 9876 nt, synthetic construct
  misc_feature 1..9876: note = derived and/or modified CDS sequence (opt1) from DENV-2__EU687246__SS-prME
  source 1..9876: mol_type = other RNA
agcgcgggcatgatcatcatgctgatccccaccgtgatggcgttccacctcaccacccgcaacggggagccccacatgatcgtgagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcacccggggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgcaagatccccttcgagatcatggacctggagaagcgctacgtgctcggccggctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcgcatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccggtccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccgcagcgtgacccggctggagaacctcatgtggaagcagatcacccccgagctgaaccacatcctggccgagaacgaggtcaagctcaccatcatgacgggggacatcaagggcatcatgcaggccgggaagcgctccctgcggccgcagcccaccgagctgaagtacagctggaagacctggggcaaggcgaagatgctctccaccgagagccacaaccagacgttcctgatcgacggccccgagaccgccgagtgcccgaacaccaaccgcgcctggaactccctggaggtggaggactacgggttcggcgtgttcaccacgaacatctggctcaagctgaaggagaagcaggacgccttctgcgacagcaagctgatgtccgccgcgatcaaggacaaccgggccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccgcccggggtaccacacccagatcgccggcccctggcacctggggaagctggagatggacttcgacttctgcgacggcaccacggtggtggtcaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtgaccgccggccacgggcaggtcgacaacttctccctgggcgtgctgggcatggccctcttcctggaggagatgctgcggacgcgcgtggggaccaagcacgccatcctcctggtcgccctgagcttcgtgaccctcatcaccggcaacatgtccttcaaggacctggggcgggtggtcgtgatggtgggcgccacgatgaccgacgacatcgggatgggcgtcacctacctggccctcctggcggccttcaaggtgcgccccaccttcgccgccggcctgctcctgcggaagctgacgagcaaggagctcatgatgaccaccatcgggatcgtgctgctgtcccagagcaacatccccgagaccatcctcgagctgacggacgccctggcgctcggcatgatggtcctgaagatcgtgcgcgacatggagaagtaccagctggccgtgaccatcatggccatcctctgcgtcccgaacgccgtgatcctgcagaacgcctggaaggtctcctgcaccatcctggcggtggtgagcgtcagccccctcctgctgaccagctcccagcagaagacggactggatccccctcgccctgaccatcaaggggctgaaccccaccgccatcttcctcaccacgctgagccgcaccaacaagaagcggtcctggccgctgaacgaggccatcatggcggtgggcatggtgagcatcctcgcctccagcctgctgaagaacgacatccccatgaccggccccctcgtcgccgggggcctgctgaccgtgtgctacgtgctcacggggcgctccgccgacctggagctggagcgggccaccgacgtcaagtgggaggaccaggcggagatcagcggcagctcccccatcctcagcatcaccatctccgaggacgggagcatgtccatcaagaacgaggaggaggagcagaccctgacgatcctgatccgcaccggcctcctggtgatcagcggcctgttcccggtgtccatccccatcaccgccgccgcctggtacctctgggaggtcaagaagcagcgggccggggtgctgtgggacgtgccctccccgccgcccatgggcaaggcggagctggaggacggggcctaccgcatcaagcagaagggcatcctcgggtactcccagatcggcgccggcgtctacaaggaggggaccttccacaccatgtggcacgtgacgcggggcgccgtgctgatgcacaaggggaagcgcatcgagcccagctgggccgacgtcaagaaggacctgatctcctacggcgggggctggaagctcgagggcgagtggaaggagggggaggaggtccaggtgctggcgctggagcccggcaagaacccccgggccgtccagaccaagcccggcctcttcaagaccaacaccggcacgatcggggccgtgagcctggacttctcccccggcaccagcggctcccccatcatcgacaagaaggggaaggtggtcggcctgtacgggaacggcgtggtgacccgcagcggcgcctacgtctccgccatcgcgcagaccgagaagtccatcgaggacaaccccgacatcgaggacgacatcttccggaagcgccggctgacgatcatggacctccaccccggggccggcaagaccaagcgctacctgcccgccatcgtgcgggaggccatcaagcgcgggctgcggaccctcatcctggcgccgacccgcgtggtcgccgccgagatggaggaggccctgcggggcctccccatccgctaccagacgcccgccatccgggcggagcacaccgggcgcgagatcgtggacctgatgtgccacgccaccttcaccatgcgcctgctctcccccgtgcgggtcccgaactacaacctgatcatcatggacgaggcccacttcacggaccccgccagcatcgccgcgcgcggctacatcagcacccgggtggagatgggcgaggccgccgggatcttcatgaccgccacgccgcccggctcccgcgacccgttcccccagagcaacgcccccatcatcgacgaggagcgggagatccccgagcgctcctggaacagcgggcacgagtgggtgacggacttcaagggcaagaccgtctggttcgtgccgtccatcaaggcggggaacgacatcgccgcctgcctgcggaagaacggcaagaaggtgatccagctcagccgcaagaccttcgactccgagtacatcaagacccggacgaacgactgggacttcgtcgtgaccaccgacatcagcgagatgggcgccaacttcaaggcggagcgcgtgatcgacccccggcgctgcatgaagcccgtcatcctgaccgacggggaggagcgggtgatcctggccggccccatgccggtgacgcactccagcgccgcccagcgccgggggcgcatcggccggaaccccaagaacgagaacgaccagtacatctacatgggggagcccctcgagaacgacgaggactgcgcccactggaaggaggcgaagatgctgctggacaacatcaacacccccgagggcatcatcccgtccatgttcgagcccgagcgcgagaaggtcgacgccatcgacggcgagtaccggctccgcggggaggcccgcaagaccttcgtggacctgatgcggcgcggcgacctgcccgtgtggctcgcctacaaggtcgccgcggaggggatcaactacgccgaccggcgctggtgcttcgacggcatcaagaacaaccagatcctggaggagaacgtggaggtggagatctggaccaaggagggggagcggaagaagctgaagccgcgctggctcgacgcccggatctacagcgaccccctggccctgaaggagttcaaggagttcgccgcgggccgcaagtccctcacgctgaacctgatcaccgagatgggccggctccccaccttcatgacccagaagacgcgcgacgccctggacaacctggccgtcctccacaccgccgaggccggcgggcgggcctacaaccacgccctgagcgagctgcccgagaccctcgagaccctgctgctcctgacgctgctcgccaccgtgaccggcgggatcttcctgttcctgatgtccgggcgcgggatcggcaagatgaccctcgggatgtgctgcatcatcaccgccagcatcctgctgtggtacgcgcagatccagccgcactggatcgccgcctccatcatcctcgagttcttcctgatcgtcctgctcatccccgagcccgagaagcagcggacgccccaggacaaccagctgacctacgtggtgatcgccatcctgaccgtcgtggccgcgaccatggccaacgagatgggcttcctcgagaagacgaagaaggacctggggctgggcagcatcgccacccagcagccggagtccaacatcctcgacatcgacctgcgccccgccagcgcctggaccctgtacgcggtggccaccacgttcatcacccccatgctccggcacagcatcgagaactccagcgtcaacgtgtccctgaccgccatcgccaaccaggccaccgtgctgatgggcctcgggaagggctggcccctgagcaagatggacatcggggtcccgctgctcgcgatcggctgctactcccaggtgaaccccatcacgctgaccgccgccctgctcctgctgatcgcccactacgcgatcatcgggcccggcctccaggccaaggccacccgcgaggcccagaagcgggccgcggccggcatcatgaagaaccccaccgtggacgggatcacggtcatcgacctggacccgatcccctacgaccccaagttcgagaagcagctgggccaggtgatgctcctggtgctgtgcgtcacccaggtgctcatgatgcgcaccacctgggccctgtgcgaggccctgacgctcgccaccgggcccatcagcaccctgtgggagggcaacccggggcggttctggaacaccacgatcgcggtgtccatggccaacatcttccgcggcagctacctggccggcgccgggctcctgttctccatcatgaagaacaccaccaacacccggcgcggcacggggaacatcggcgagaccctgggcgagaagtggaagtcccgcctcaacgccctggggaagtccgagttccagatctacaagaagtccggcatccaggaggtcgaccggaccctggcgaaggaggggatcaagcgcggcgagaccgaccaccacgccgtgtcccgggggagcgccaagctccgctggttcgtggagcggaacatggtcacgcccgagggcaaggtggtggacctgggctgcgggcgcggcgggtggtcctactactgcggcgggctgaagaacgtccgggaggtgaagggcctcaccaagggcgggcccggccacgaggagcccatcccgatgagcacctacgggtggaacctggtgcgcctgcagtccggcgtcgacgtgttcttcatcccgcccgagaagtgcgacaccctcctgtgcgacatcggggagagctcccccaacccgacggtggaggccggccggaccctgcgcgtcctcaacctggtggagaactggctgaacaacaacacccagttctgcatcaaggtgctgaacccctacatgcccagcgtcatcgagaagatggagaccctccagcggaagtacggcggggcgctggtgcgcaacccgctgagccggaactccacccacgagatgtactgggtgagcaacgcctccggcaacatcgtcagctccgtgaacatgatcagccgcatgctcatcaaccggttcacgatgcgccacaagaaggccacctacgagcccgacgtggacctggggtccggcacccggaacatcgggatcgagagcgagatccccaacctggacatcatcggcaagcgcatcgagaagatcaagcaggagcacgagacctcctggcactacgaccaggaccacccctacaagacgtgggcctaccacggcagctacgagaccaagcagaccgggtccgccagctccatggtcaacggcgtggtgcggctcctgaccaagccgtgggacgtcctgcccacggtgacccagatggcgatgaccgacaccacgcccttcgggcagcagcgcgtgttcaaggagaaggtcgacacccgcacccaggagcccaaggagggcaccaagaagctcatgaagatcacggccgagtggctgtggaaggagctgggcaagaagaagaccccgcggatgtgcacccgcgaggagttcacccggaaggtgcgcagcaacgccgccctcggggccatcttcacggacgagaacaagtggaagtccgcgcgggaggccgtggaggacagccgcttctgggagctggtcgacaaggagcggaacctgcacctcgagggcaagtgcgagacctgcgtgtacaacatgatggggaagcgcgagaagaagctgggcgagttcgggaaggccaagggctcccgggccatctggtacatgtggctgggcgcccgcttcctcgagttcgaggcgctggggttcctgaacgaggaccactggttcagccgggagaactccctcagcggcgtggagggggagggcctgcacaagctggggtacatcctccgcgacgtcagcaagaaggagggcggcgccatgtacgccgacgacaccgccgggtgggacacccggatcacgctggaggacctgaagaacgaggagatggtgaccaaccacatggagggcgagcacaagaagctcgcggaggccatcttcaagctgacctaccagaacaaggtcgtgcgcgtgcagcggcccacgccccgggggacggtcatggacatcatctcccggcgcgaccagcggggcagcggccaggtggggacctacggcctgaacaccttcaccaacatggaggcccagctcatccgccagatggagggggagggcgtgttcaagaacatccagcacctgacggtcaccgaggagatcgccgtgcagaactggctggcccgggtggggcgcgagcgcctctcccggatggcgatcagcggcgacgactgcgtcgtgaagcccctggacgaccgcttcgcctccgccctgaccgccctcaacgacatgggcaagatccggaaggacatccagcagtgggagccgagccgcgggtggaacgactggacccaggtgcccttctgctcccaccacttccacgagctgatcatgaaggacggccgggtcctggtggtgccctgccgcaaccaggacgagctcatcgggcgggcccgcatcagccagggcgcggggtggtccctgcgggagacggcctgcctgggcaagagctacgcccagatgtggtccctcatgtacttccaccgccgggacctgcgcctggccgccaacgcgatctgcagcgccgtcccctcccactgggtgccgaccagccggaccacctggtccatccacgccaagcacgagtggatgaccacggaggacatgctcaccgtgtggaaccgcgtctggatccaggagaacccctggatggaggacaagacccccgtggagagctgggaggagatcccctacctgggcaagcgggaggaccagtggtgcgggtccctgatcggcctcaccagccgcgccacgtgggccaagaacatccaggcggccatcaaccaggtgcggagcctgatcgggtccgaggagtacaccgactacatgccgagcatgaagcgcttccggcgcgaggaggaggaggccggcgtcctgtggtga

SEQ ID NO: 9328 - RNA, 9876 nt, synthetic construct
  misc_feature 1..9876: note = derived and/or modified CDS sequence (opt1) from DENV-2__FJ639828__SS-prME
  source 1..9876: mol_type = other RNA
agcgtgggcatgatcatcatgctgatccccaccgtcatggccttccacctcaccacccgcaacggggagccccacatgatcgtgagcatccaggagaagggcaagagcctgctgttcaagaccgaggacggggtgaacatgtgcaccctcatggccatggacctgggcgagctgtgcgaggacaccatcacctacaagtgccccctcctgcggcagaacgagcccgaggacatcgactgctggtgcaactccaccagcacctgggtcacctacgggacctgcaccaccaccggcgagcaccgccgggagaagcgctccgtggcgctggtgccccacgtcggcatggggctcgagacgcggaccgagacctggatgagctccgagggcgcctggaagcacgcccagcgcatcgagacctggatcctgcggcacccggggttcacgatcatggccgccatcctggcgtacaccatcggcaccacccacttccagcgcacgctcatcttcatcctgctgaccgccgtggcccccagcatgaccatgcggtgcatcgggatctccaaccgcgacttcgtggagggcgtcagcggcgggtcctgggtggacatcgtgctcgagcacggcagctgcgtcaccacgatggccaagaacaagcccaccctggacttcgagctgatcaagaccgaggcgaagcagcccgccaccctccggaagtactgcatcgaggccaagctgacgaacaccaccaccgagtcccgctgccccacgcagggggagcccagcctgaaggaggagcaggacaagcggttcgtgtgcaagcactccatggtggaccgcggctggggcaacgggtgcggcctcttcgggaagggcgggatcgtgacctgcgccatgttcacgtgcaagaagaacatggagggcaagatcgtgcagcccgagaacctggagtacaccatcgtggtcacgccccacagcggcgaggagcacgccgtggggaacgacaccggcaagcacgggaaggagatcaaggtgaccccgcagtccagcatcaccgaggcggagctgaccggctacgggacggtcaccatggagtgcagcccccggaccggcctcgacttcaacgagatggtgctgctgcagatggagaacaaggcctggctcgtgcaccgccagtggttcctggacctgcccctcccctggctgccgggcgccgacacccaggggagcaactggatccagaaggagacgctggtcaccttcaagaacccccacgccaagaagcaggacgtggtcgtgctcggcagccaggagggggccatgcacaccgcgctgaccggcgccacggagatccagatgtccagcgggaacctcctgttcaccggccacctgaagtgccggctgcgcatggacaagctccagctgaagggcatgtcctacagcatgtgcaccgggaagttcaaggtggtcaaggagatcgccgagacccagcacggcacgatcgtgatccgggtgcagtacgagggggacggctccccctgcaagatccccttcgagatcatggacctggagaagcgctacgtcctcggccggctgatcaccgtgaacccgatcgccaccgagaaggacagccccgtgaacatcgaggccgagccgcccttcggggactcctacatcatcatcggcgtcgagccggggcagctgaagctcaactggttcaagaagggcagctccatcgggcagatgttcgagaccacgatgcgcggcgcgaagcgcatggccatcctgggcgacaccgcctgggacttcgggagcctgggcggggtgttcacctccatcggcaaggccctccaccaggtgttcggggccatctacggcgcggccttcagcggcgtctcctggaccatgaagatcctgatcggggtgatcatcacgtggatcggcatgaacagccggtccaccagcctgtccgtgagcctggtcctcgtgggggtggtcaccctgtacctgggcgtgatggtgcaggccgactccgggtgcgtcgtgagctggaagaacaaggagctcaagtgcggcagcggcatcttcatcaccgacaacgtgcacacgtggaccgagcagtacaagttccagcccgagtcccccagcaagctggcctccgcgatccagaaggcccaggaggaggggatctgcggcatccgcagcgtcacccggctggagaacctcatgtggaagcagatcacccccgagctgaaccacatcctggccgagaacgaggtgaagctcacgatcatgaccggggacatcaagggcatcatgcaggccgggaagcgctccctgcggccgcagcccaccgagctgaagtacagctggaagacctggggcaaggccaagatgctctccacggagagccacaaccagaccttcctgatcgacggccccgagaccgcggagtgcccgaacaccaaccgcgcctggaactccctggaggtggaggactacgggttcggcgtcttcacgaccaacatctggctcaagctgaaggagaagcaggacgccttctgcgacagcaagctgatgtccgccgccatcaaggacaaccgggcggtgcacgccgacatggggtactggatcgagagcgccctcaacgacacctggaagatcgagaaggcctccttcatcgaggtgaagaactgccactggcccaagagccacaccctgtggtccaacggcgtcctggagagcgagatgatcatccccaagaacctcgccggccccgtgtcccagcacaactaccgcccggggtaccacacccagatcgcgggcccctggcacctggggaagctggagatggacttcgacttctgcgacggcacgaccgtggtcgtgaccgaggactgcgggaaccggggccccagcctccgcaccacgaccgccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtcacggccggccacgggcaggtcgacaacttctccctgggcgtgctgggcatggccctcttcctggaggagatgctgcggacccgcgtcgggaccaagcacgcgatcctcctggtggccgtgagcttcgtcaccctgatcacgggcaacatgtccttcaaggacctcgggcgggtggtggtcatggtgggcgccaccatgaccgacgacatcgggatgggcgtgacctacctggccctgctcgccgcgttcaaggtccgccccacgttcgccgccggcctgttcctgcggaagctcaccagcaaggagctgatgatgaccaccatcgggatcgtgctgctctcccagagcacgctgcccgagaccatcctggagctcaccgacgccctggccctgggcatgatggtgctcaagatggtccgcgacatggagaagtaccagctggcggtgaccatcatggccatcctgtgcgtcccgaacgccgtgatcctccagaacgcctggaaggtgtcctgcacgatcctggccgtcgtgagcgtgagccccctgctcctgaccagctcccagcagaagaccgactggatccccctggcgctcaccatcaaggggctgaaccccacggccatcttcctgaccaccctcagccgcaccaacaagaagcggtcctggccgctgaacgaggccatcatggccgtcggcatggtgagcatcctggcgtccagcctcctgaagaacgacatccccatgacgggccccctggtggccgggggcctcctgaccgtctgctacgtgctgaccgggcgctccgccgacctcgagctggagcgggccaccgacgtgaagtgggaggaccaggccgagatcagcggcagctcccccatcctgagcatcacgatctccgaggacgggagcatgtccatcaagaacgaggaggaggagcagaccctcaccatcctgatccgcaccggcctgctcgtcatcagcggcctgttcccggtgtccatccccatcaccgcggccgcctggtacctgtgggaggtgaagaagcagcgggccggggtcctctgggacgtgccctccccgccgcccatgggcaaggccgagctggaggacggggcgtaccgcatcaagcagcggggcatcctggggtactcccagatcggcgccggcgtgtacaaggaggggacgttccacaccatgtggcacgtcacccgcggcgccgtgctcacccacaaggggaagcggatcgagcccagctgggccgacgtgaagaaggacctgatctcctacggcgggggctggaagctggagggcgagtggaaggagggggaggaggtccaggtgctcgccctggagcccggcaagaacccccgcgcggtgcagacgaagcccgggctgttcaagaccaacaccggcaccatcggggccgtcagcctcgacttctcccccggcacgagcggctcccccatcatcgacaagaaggggaaggtggtgggcctgtacgggaacggcgtcgtgacccggagcggcgcctacgtgtccgccatcgcccagaccgagaagtccatcgaggacaaccccgacatcgaggacgacatcttccgcaagcggcgcctgaccatcatggacctgcaccccggggcgggcaagacgaagcggtacctccccgccatcgtccgcgaggccatcaagcgggggctgcgcaccctgatcctcgccccgacccgggtggtggcggccgagatggaggaggccctgcgcggcctgcccatccggtaccagacccccgccatccgcgccgagcacacggggcgcgagatcgtcgacctcatgtgccacgcgaccttcaccatgcggctgctgtcccccgtgcgcgtgccgaactacaacctcatcatcatggacgaggcccacttcaccgaccccgccagcatcgccgcccggggctacatcagcacgcgcgtcgagatgggcgaggcggccgggatcttcatgaccgccacgccgcccggctcccgggacccgttcccccagagcaacgcccccatcatcgacgaggagcgcgagatccccgagcggtcctggaacagcgggcacgagtgggtgaccgacttcaagggcaagacggtgtggttcgtcccgtccatcaaggccgggaacgacatcgcggcctgcctgcgcaagaacggcaagaaggtgatccagctgagccggaagaccttcgactccgagtacgtgaagacccgcaccaacgactgggacttcgtcgtgacgaccgacatcagcgagatgggcgccaacttcaaggccgagcgggtgatcgacccccgccggtgcatgaagcccgtcatcctcaccgacggggaggagcgcgtgatcctggcgggccccatgccggtgacccactccagcgccgcccagcggcgcgggcggatcggccgcaaccccaagaacgagaacgaccagtacatctacatgggggagcccctggagaacgacgaggactgcgcccactggaaggaggccaagatgctcctggacaacatcaacacgcccgagggcatcatcccgtccatgttcgagcccgagcgggagaaggtcgacgcgatcgacggcgagtaccgcctgcgcggggaggcccggaagaccttcgtggacctcatgcgccggggcgacctgcccgtgtggctggcctacaaggtcgccgccgaggggatcaactacgcggaccgccggtggtgcttcgacggcatcaagaacaaccagatcctcgaggagaacgtggaggtcgagatctggaccaaggagggggagcgcaagaagctgaagccgcggtggctggacgcccgcatctacagcgaccccctcgccctgaaggagttcaaggagttcgccgccggccggaagtccctgaccctcaacctgatcacggagatgggccgcctgcccaccttcatgacccagaagacccgggacgcgctcgacaacctggccgtgctgcacacggccgaggccgggggccgcgcgtacaaccacgccctcagcgagctgcccgagaccctggagaccctcctgctgctcaccctgctggccaccgtgaccggcgggatcttcctcttcctgatgtccgggcgggggatcggcaagatgaccctggggatgtgctgcatcgtcaccgccagcatcctcctgtggtacgcccagatccagccgcactggatcgcggcctccatcatcctggagttcttcctcatcgtgctgctgatccccgagcccgagaagcagcgcacgccccaggacaaccagctcacgtacgtggtcatcgccatcctgaccgtggtggccgccaccatggcgaacgagatgggcttcctggagaagaccaagaaggacctcgggctgggcagcatcgccacgcagcagccggagtccaacatcctggacatcgacctccggcccgccagcgcctggaccctgtacgccgtcgcgaccaccttcgtgacgcccatgctgcgccacagcatcgagaactccagcgtgaacgtctccctcaccgccatcgccaaccaggccaccgtgctgatgggcctggggaagggctggcccctcagcaagatggacatcggggccccgctgctggcgatcggctgctactcccaggtgaaccccatcaccctcacggccgccctgctgctcctggtcgcccactacgcgatcatcgggcccggcctgcaggccaaggccacccgggaggcccagaagcgcgccgcggccggcatcatgaagaaccccaccgtggacgggatcaccgtgatcgacctcgacccgatcccctacgaccccaagttcgagaagcagctgggccaggtcatgctgctcgtgctgtgcgtgacgcaggtcctgatgatgcggaccacctgggccctctgcgaggccctgaccctggccacggggcccatcagcaccctctgggagggcaacccggggcgcttctggaacaccaccatcgcggtgtccatggccaacatcttccggggcagctacctggccggcgccgggctcctgttctccatcatgaagaacacgaccaacagccgccgcggcaccgggaacatcggcgagaccctgggcgagaagtggaagtcccggctgaacgccctcggcaagagcgagttccagatctacaagaagtccggcatccaggaggtggaccgcacgctggcgaaggaggggatcaagcggggcgagaccgaccaccacgccgtcagccgcgggtccgccaagctgcggtggttcgtggagcgcaacatggtgacccccgagggcaaggtcgtggacctcggctgcgggcggggcgggtggagctactactgcggcgggctgaagaacgtgcgcgaggtcaagggcctgaccaagggcgggcccggccacgaggagcccatcccgatgtccacgtacgggtggaacctcgtgcggctgcagagcggcgtggacgtcttcttcatcccgcccgagaagtgcgacaccctgctctgcgacatcggggagtccagccccaacccgaccgtggaggccggccgcaccctgcgggtgctgaacctcgtcgagaactggctgaacaacaacacccagttctgcatcaaggtgctgaacccctacatgcccagcgtgatcgagaagatggagacgctgcagcgcaagtacggcggggcgctcgtccggaacccgctgtcccgcaacagcacccacgagatgtactgggtgtccaacgccagcggcaacatcgtgtccagcgtcaacatgatctcccggatgctgatcaaccgcttcaccatgcggcacaagaaggccacctacgagcccgacgtggacctcgggagcggcacgcgcaacatcgggatcgagtccgagatccccaacctggacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctcaccaagccgtgggacgtgctgcccaccgtcacccagatggcgatgacggacaccacccccttcgggcagcagcgcgtgttcaaggagaaggtggacacccggacgcaggagcccaaggagggcaccaagaagctgatgaagatcaccgccgagtggctctggaaggagctgggcaagaagaagaccccgcgcatgtgcacgcgggaggagttcacccgcaaggtccggtccaacgccgccctgggggccatcttcaccgacgagaacaagtggaagtccgcgcgcgaggccgtggaggactcccggttctgggagctcgtcgacaaggagcgcaacctgcacctggagggcaagtgcgagacctgcgtgtacaacatgatggggaagcgggagaagaagctcggcgagttcgggaaggccaagggcagccgcgccatctggtacatgtggctgggcgcccggttcctggagttcgaggcgctcgggttcctgaacgaggaccactggttctcccgcgagaacagcctgagcggcgtggagggggagggcctccaccggctggggtacatcctgcgcgacgtctccaagaaggagggcggcgccatgtacgccgacgacacggccgggtgggacacccggatcaccctcgaggacctgaagaacgaggagatggtgaccaaccacatggagggcgagcacaagaagctggcggaggccatcttcaagctcacgtaccagaacaaggtggtccgcgtgcagcggcccacgccccgggggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggagatcgccgtccagaactggctggcccgcgtggggcgggagcgcctgagccggatggcgatctccggcgacgactgcgtggtcaagcccctcgacgaccgcttcgccagcgccctgacggccctgaacgacatgggcaagatccggaaggacatccagcagtgggagccgtcccgcgggtggaacgactggacccaggtgcccttctgcagccaccacttccacgagctcatcatgaaggacggccgggtgctggtcgtgccctgccgcaaccaggacgagctgatcgggcgggcccgcatctcccagggcgcggggtggagcctccgggagaccgcctgcctgggcaagtcctacgcccagatgtggagcctgatgtacttccaccgccgggacctccgcctggccgccaacgcgatctgctccgccgtgcccagccactgggtcccgacctcccggaccacgtggagcatccacgccaagcacgagtggatgaccaccgaggacatgctgaccgtgtggaaccgcgtgtggatccaggagaacccctggatggaggacaagacgcccgtcgagtcctgggaggagatcccctacctcggcaagcgggaggaccagtggtgcgggagcctgatcggcctgaccagccgcgccacctgggccaagaacatccaggcggccatcaaccaggtgcggtccctcatcgggaacgaggagtacaccgactacatgccgagcatgaagcgcttccgccgggaggaggaggaggccggcgtgctgtggtga

SEQ ID NO: 9329 - RNA, 9876 nt, synthetic construct
  misc_feature 1..9876: note = derived and/or modified CDS sequence (opt1) from DENV-2__FJ639829__SS-prME
  source 1..9876: mol_type = other RNA
agcgtgggcatgatcatcatgctgatccccaccgtgatggcgttccacctcaccacccgcaacggggagccccacatgatcgtgagcatccaggagaagggcaagagcctgctgttcaagaccgaggacggggtgaacatgtgcaccctcatggccatggacctgggcgagctgtgcgaggacaccatcacctacaagtgccccctcctgcggcagaacgagcccgaggacatcgactgctggtgcaactccaccagcacctgggtcacctacgggacgtgcaccaccaccggcgagcaccgccgggagaagcgctccgtggcgctggtgccccacgtcggcatggggctcgagacgcggaccgagacctggatgagctccgagggcgcctggaagcacgcccagcgcatcgagacctggatcctgcggcacccggggttcacgatcatggccgccatcctggcgtacaccatcggcaccacccacttccagcgcacgctcatcttcatcctgctgaccgccgtggcccccagcatgaccatgcggtgcatcgggatctccaaccgcgacttcgtggagggcgtcagcggcgggtcctgggtggacatcgtgctcgagcacggcagctgcgtcaccacgatggccaagaacaagcccaccctggacttcgagctgatcaagaccgaggcgaagcagcccgccaccctccggaagtactgcatcgaggccaagctgacgaacaccaccaccgagtcccgctgccccacgcagggggagcccagcctgaaggaggagcaggacaagcggttcgtgtgcaagcactccatggtggaccgcggctggggcaacgggtgcggcctcttcgggaagggcgggatcgtgacctgcgccatgttcacgtgcaagaagaacatggagggcaagatcgtgcagcccgagaacctggagtacaccatcgtggtcacgccccacagcggcgaggagcacgccgtggggaacgacaccggcaagcacgggaaggagatcaaggtgaccccgcagtccagcatcaccgaggcggagctgaccggctacgggacggtcaccatggagtgcagcccccggaccggcctcgacttcaacgagatggtgctgctgcagatggagaacaaggcctggctcgtgcaccgccagtggttcctggacctgcccctcccctggctgccgggcgccgacacccaggggagcaactggatccagaaggagacgctggtcaccttcaagaacccccacgccaagaagcaggacgtggtcgtgctcggcagccaggagggggccatgcacaccgcgctgaccggcgccacggagatccagatgtccagcgggaacctcctgttcaccggccacctgaagtgccggctgcgcatggacaagctccagctgaagggcatgtcctacagcatgtgcaccgggaagttcaaggtggtcaaggagatcgccgagacccagcacggcacgatcgtgatccgggtgcagtacgagggggacggctccccctgcaagatccccttcgagatcatggacctggagaagcgctacgtcctcggccggctgatcaccgtgaacccgatcgtgaccgagaaggacagccccgtcaacatcgaggccgagccgcccttcggggactcctacatcatcatcggcgtggagccggggcagctgaagctcaactggttcaagaagggcagctccatcgggcagatgttcgagaccacgatgcgcggcgccaagcgcatggcgatcctgggcgacaccgcctgggacttcgggagcctgggcggggtgttcacctccatcggcaaggccctccaccaggtcttcggggccatctacggcgccgcgttcagcggcgtgtcctggaccatgaagatcctgatcggggtgatcatcacgtggatcggcatgaacagccggtccaccagcctgtccgtcagcctggtgctcgtgggggtcgtgaccctgtacctgggcgtgatggtccaggccgactccgggtgcgtggtgagctggaagaacaaggagctcaagtgcggcagcggcatcttcatcaccgacaacgtccacacgtggaccgagcagtacaagttccagcccgagtcccccagcaagctggcctccgccatccagaaggcgcaggaggaggggatctgcggcatccgcagcgtgacccggctggagaacctcatgtggaagcagatcacccccgagctgaaccacatcctggccgagaacgaggtgaagctcacgatcatgaccggggacatcaagggcatcatgcaggccgggaagcgctccctgcggccgcagcccaccgagctgaagtacagctggaagacctggggcaaggccaagatgctctccacggagagccacaaccagaccttcctgatcgacggccccgagaccgccgagtgcccgaacaccaaccgcgcgtggaactccctggaggtcgaggactacgggttcggcgtgttcacgaccaacatctggctcaagctgaaggagaagcaggacgccttctgcgacagcaagctgatgtccgccgccatcaaggacaaccgggccgtgcacgcggacatggggtactggatcgagagcgccctcaacgacacctggaagatcgagaaggcctccttcatcgaggtcaagaactgccactggcccaagagccacaccctgtggtccaacggcgtgctggagagcgagatgatcatccccaagaacctcgccggccccgtgtcccagcacaactaccgcccggggtaccacacccagatcgccggcccctggcacctggggaagctggagatggacttcgacttctgcgacggcacgaccgtcgtggtgaccgaggactgcgggaaccggggccccagcctccgcaccacgaccgcgagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgacggccggccacgggcaggtcgacaacttctccctgggcgtcctgggcatggccctcttcctggaggagatgctgcggacccgcgtggggaccaagcacgccatcctcctggtggcggtcagcttcgtgaccctgatcacgggcaacatgtccttcaaggacctcgggcgggtggtcgtgatggtgggcgccaccatgaccgacgacatcgggatgggcgtcacctacctggccctgctcgccgccttcaaggtgcgccccacgttcgcggccggcctgttcctgcggaagctcaccagcaaggagctgatgatgaccaccatcgggatcgtgctgctctcccagagcacgatccccgagaccatcctggagctgaccgacgccctcgccctgggcatgatggtcctgaagatggtgcgcgacatggagaagtaccagctcgccgtcaccatcatggcgatcctgtgcgtgccgaacgccgtgatcctgcagaacgcctggaaggtctcctgcacgatcctcgccgtggtgagcgtcagccccctgctgctcaccagctcccagcagaagaccgactggatccccctggccctgaccatcaaggggctcaaccccacggcgatcttcctgaccaccctgagccgcaccaacaagaagcggtcctggccgctcaacgaggccatcatggccgtgggcatggtgagcatcctggcctccagcctgctcaagaacgacatccccatgacgggccccctggtcgccggcgggctgctcaccgtgtgctacgtgctgaccgggcgctccgccgacctggagctcgagcgggccaccgacgtcaagtgggaggaccaggccgagatcagcgggagctcccccatcctgagcatcacgatctccgaggacgggagcatgtccatcaagaacgaggaggaggagcagaccctgaccatcctcatccgcaccggcctgctggtgatcagcggcctcttcccggtgtccatccccatcaccgccgcggcctggtacctgtgggaggtcaagaagcagcgggccggggtgctgtgggacgtgccctccccgccgcccatgggcaaggccgagctcgaggacggggcctaccgcatcaagcagcggggcatcctggggtactcccagatcggcgcgggcgtctacaaggaggggacgttccacaccatgtggcacgtgacccgcggcgccgtgctgacccacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgagcctggacttctcccccggcacgagcggctcccccatcatcgacaagaaggggaaggtggtcggcctctacgggaacggcgtggtgacccggagcggcgcctacgtctccgccatcgcccagaccgagaagtccatcgaggacaaccccgacatcgaggacgacatcttccgcaagcggcgcctgaccatcatggacctgcaccccggggccggcaagacgaagcggtacctgcccgcgatcgtgcgcgaggccatcaagcgggggctccgcaccctgatcctggccccgacccgggtggtcgccgcggagatggaggaggccctccgcggcctgcccatccggtaccagacccccgccatccgcgccgagcacacggggcgcgagatcgtggacctgatgtgccacgccaccttcaccatgcggctcctgtcccccgtgcgcgtcccgaactacaacctgatcatcatggacgaggcgcacttcaccgaccccgccagcatcgccgcccggggctacatcagcacgcgcgtggagatgggcgaggccgcggggatcttcatgaccgccacgccgcccggctcccgggacccgttcccccagagcaacgcccccatcatcgacgaggagcgcgagatccccgagcggtcctggaacagcgggcacgagtgggtgaccgacttcaagggcaagacggtctggttcgtgccgtccatcaaggccgggaacgacatcgccgcgtgcctccgcaagaacggcaagaaggtgatccagctgagccggaagaccttcgactccgagtacgtcaagacccgcaccaacgactgggacttcgtggtgacgaccgacatcagcgagatgggcgccaacttcaaggccgagcgggtcatcgacccccgccggtgcatgaagcccgtgatcctgaccgacggggaggagcgcgtgatcctcgccggccccatgccggtcacccactccagcgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacgcccgagggcatcatcccgtccatgttcgagcccgagcgggagaaggtggacgccatcgacggcgagtaccgcctgcgcggggaggcgcggaagaccttcgtggacctgatgcgccggggcgacctccccgtctggctggcctacaaggtggccgccgaggggatcaactacgccgaccgccggtggtgcttcgacggcatcaagaacaaccagatcctggaggagaacgtcgaggtggagatctggaccaaggagggggagcgcaagaagctcaagccgcggtggctggacgcgcgcatctacagcgaccccctggccctcaaggagttcaaggagttcgccgccggccggaagtccctgaccctgaacctcatcacggagatgggccgcctgcccaccttcatgacccagaagacccgggacgccctggacaacctcgcggtgctgcacacggccgaggccgggggccgcgcctacaaccacgcgctgagcgagctccccgagaccctggagaccctgctcctgctgaccctcctggccaccgtcaccgggggcatcttcctgttcctcatgtccggccgggggatcggcaagatgaccctggggatgtgctgcatcgtgaccgccagcatcctgctctggtacgcccagatccagccgcactggatcgccgcgtccatcatcctggagttcttcctgatcgtgctcctgatccccgagcccgagaagcagcgcacgccccaggacaaccagctgacgtacgtcgtgatcgccatcctcaccgtggtcgccgccaccatggccaacgagatgggcttcctggagaagaccaagaaggacctggggctcggcagcatcgcgacgcagcagccggagtccaacatcctggacatcgacctgcggcccgccagcgcctggaccctctacgccgtggccaccaccttcgtgacgcccatgctgcgccacagcatcgagaactccagcgtcaacgtgtccctgaccgcgatcgccaaccaggccaccgtgctcatgggcctggggaagggctggcccctgagcaagatggacatcggggccccgctcctggccatcggctgctactcccaggtcaaccccatcaccctgacggcggccctcctgctgctcgtggcccactacgccatcatcgggcccggcctgcaggcgaaggccacccgggaggcccagaagcgcgccgccgcgggcatcatgaagaaccccaccgtggacgggatcaccgtcatcgacctggacccgatcccctacgaccccaagttcgagaagcagctcggccaggtgatgctgctggtgctctgcgtcacccaggtgctgatgatgcggaccacctgggccctgtgcgaggccctcaccctggccacggggcccatcagcaccctgtgggagggcaacccggggcgcttctggaacaccaccatcgccgtgtccatggcgaacatcttccggggcagctacctcgccggcgccgggctgctgttctccatcatgaagaacacgaccaacagccgccgcggcaccgggaacatcggcgagaccctcggcgagaagtggaagtcccggctgaacgccctgggcaagagcgagttccagatctacaagaagtccggcatccaggaggtcgaccgcacgctcgccaaggaggggatcaagcggggcgagaccgaccaccacgcggtgagccgcgggtccgccaagctgcggtggttcgtggagcgcaacatggtcacccccgagggcaaggtggtggacctgggctgcgggcggggcgggtggagctactactgcggcgggctcaagaacgtccgcgaggtgaagggcctgaccaagggcgggcccggccacgaggagcccatcccgatgtccacgtacgggtggaacctggtgcggctccagagcggcgtcgacgtgttcttcatcccgcccgagaagtgcgacaccctgctgtgcgacatcggggagtccagccccaacccgaccgtggaggccggccgcaccctccgggtcctgaacctggtggagaactggctcaacaacaacacccagttctgcatcaaggtgctgaacccctacatgcccagcgtcatcgagaagatggagacgctgcagcgcaagtacggcggggccctggtgcggaacccgctctcccgcaacagcacccacgagatgtactgggtgtccaacgcgagcggcaacatcgtctccagcgtgaacatgatctcccggatgctgatcaaccgcttcaccatgcggcacaagaaggccacctacgagcccgacgtggacctggggagcggcacgcgcaacatcgggatcgagtccgagatccccaacctcgacatcatcggcaagcggatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctgaccaagccgtgggacgtcctccccaccgtgacccagatggccatgacggacaccacccccttcgggcagcagcgcgtgttcaaggagaaggtcgacacccggacgcaggagcccaaggagggcaccaagaagctgatgaagatcaccgcggagtggctgtggaaggagctcggcaagaagaagaccccgcgcatgtgcacgcgggaggagttcacccgcaaggtgcggtccaacgccgccctgggggccatcttcaccgacgagaacaagtggaagtccgcccgcgaggcggtcgaggactcccggttctgggagctggtggacaaggagcgcaacctccacctggagggcaagtgcgagacctgcgtgtacaacatgatggggaagcgggagaagaagctgggcgagttcgggaaggccaagggcagccgcgccatctggtacatgtggctcggcgcccggttcctggagttcgaggccctggggttcctcaacgaggaccactggttctcccgcgagaacagcctgagcggcgtcgagggggagggcctgcaccggctcgggtacatcctgcgcgacgtgtccaagaaggagggcggcgcgatgtacgccgacgacacggccgggtgggacacccggatcaccctggaggacctcaagaacgaggagatggtgaccaaccacatggagggcgagcacaagaagctggccgaggcgatcttcaagctgacgtaccagaacaaggtcgtgcgcgtgcagcggcccacgccccgggggaccgtcatggacatcatcagccggcgcgaccagcggggctccggccaggtggggacctacggcctcaacacgttcaccaacatggaggcccagctgatccgccagatggagggggagggcgtgttcaagaacatccagcacctgaccgtcaccgaggagatcgccgtgcagaactggctcgcccgcgtggggcgggagcgcctgagccggatggccatctccggcgacgactgcgtcgtgaagcccctggacgaccgcttcgcgagcgccctcacggccctgaacgacatgggcaagatccggaaggacatccagcagtgggagccgtcccgcgggtggaacgactggacccaggtgcccttctgcagccaccacttccacgagctgatcatgaaggacggccgggtcctcgtggtgccctgccgcaaccaggacgagctgatcgggcgggcccgcatctcccagggcgccgggtggagcctgcgggagaccgcgtgcctcggcaagtcctacgcccagatgtggagcctgatgtacttccaccgccgggacctgcgcctcgccgccaacgccatctgctccgcggtccccagccactgggtgccgacctcccggaccacgtggagcatccacgccaagcacgagtggatgaccaccgaggacatgctgaccgtgtggaaccgcgtctggatccaggagaacccctggatggaggacaagacgcccgtggagtcctgggaggagatcccctacctgggcaagcgggaggaccagtggtgcgggagcctcatcggcctgaccagccgcgccacctgggccaagaacatccaggtggccatcaaccaggtccggtccctgatcgggaacgaggagtacaccgactacatgccgagcatgaagcgcttccgccgggaggaggaggaggcgggcgtgctctggtga

SEQ ID NO: 9330 - RNA, 9876 nt, synthetic construct
  misc_feature 1..9876: note = derived and/or modified CDS sequence (opt1) from DENV-2__FJ639831__SS-prME
  source 1..9876: mol_type = other RNA
agcgcgggcatgatcatcatgctgatccccaccgtgatggccttccacctcaccacccgcaacggggagccccacatgatcgtgagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcacccggggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatcgtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcgtgaccgaggccgagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacacccaggggagcaactggatccagaaggagaccctggtcacgttcaagaacccccacgcgaagaagcaggacgtggtcgtgctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtcaaggagatcgccgagacccagcacggcaccatcgtgatccgggtgcagtacgagggggacggctccccctgcaagatccccttcgagatcatggacctggagaagcgctacgtcctcggccggctgatcacggtgaacccgatcgtgaccgagaaggacagccccgtcaacatcgaggcggagccgcccttcggggactcctacatcatcatcggcgtggagccggggcagctgaagctcaactggttcaagaagggcagctccatcgggcagatgttcgagaccaccatgcgcggcgccaagcgcatggccatcctgggcgacacggcctgggacttcgggagcctgggcggggtgttcacctccatcggcaaggccctccaccaggtcttcggggcgatctacggcgccgccttcagcggcgtgtcctggaccatgaagatcctgatcggggtgatcatcacctggatcggcatgaacagccggtccacgagcctgtccgtcagcctggtgctcgtggggatcgtcaccctgtacctgggcgtgatggtgcaggccgactccgggtgcgtcgtgagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccgcagcgtcacccggctggagaacctcatgtggaagcagatcacccccgagctgaaccacatcctggccgagaacgaggtgaagctcaccatcatgacgggggacatcaagggcatcatgcaggccgggaagcgctccctgcggccgcagcccaccgagctgaagtacagctggaagacctggggcaaggcgaagatgctctccaccgagagccacaaccagacgttcctgatcgacggccccgagaccgccgagtgcccgaacaccaaccgcgcctggaactccctggaggtggaggactacgggttcggcgtcttcaccacgaacatctggctcaagctgaaggagaagcaggacgccttctgcgacagcaagctgatgtccgccgcgatcaaggacaaccgggccgtgcacgccgacatggggtactggatcgagagcgccctcaacgacacctggaagatcgagaaggcctccttcatcgaggtgaagaactgccactggcccaagagccacaccctgtggtccaacggcgtcctggagagcgagatgatcatccccaagaacctcgcgggccccgtgtcccagcacaactaccgcccggggtaccacacccagatcgccggcccctggcacctggggaagctggagatggacttcgacttctgcgacggcaccacggtggtcgtgaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtcaccgccggccacgggcagatcgacaacttctccctgggcgtgctgggcatggccctcttcctggaggagatgctgcggacgcgcgtggggaccaagcacgccatcctcctggtcgccgtgagcttcgtgaccctgatcaccggcaacatgtccttcaaggacctcgggcgggtcgtggtgatggtcggcgccacgatgaccgacgacatcgggatgggcgtgacctacctggccctgctcgcggccttcaaggtgcgccccaccttcgtcgccggcctgctgctccggaagctgacgagcaaggagctgatgatgaccaccatcgggatcgtgctcctgtcccagagcaccatccccgagacgatcctggagctcaccgacgccctggccctgggcatgatggtgctcaagatcgtccgcgacatggagaagtaccagctggcggtgaccatcatggccatcctgtgcgtcccgaacgccgtgatcctccagaacgcctggaaggtgtcctgcaccatcctggccgtcgtgagcgtgagccccctgctcctgacgagctcccagcagaagaccgactggatccccctggcgctcaccatcaaggggctgaaccccaccgccatcttcctgacgaccctcagccgcaccaacaagaagcggtcctggccgctgaacgaggccatcatggccgtcggcatggtgagcatcctggcgtccagcctcctgaagaacgacatccccatgaccggccccctggtggccgggggcctcctgacggtctgctacgtgctgaccgggcgctccgccgacctcgagctggagcgggccaccgacgtgaagtgggaggaccaggccgagatcagcggcagctcccccatcctgagcatcaccatctccgaggacgggagcatgtccatcaagaacgaggaggaggagcagacgctcaccatcctgatccgcaccggcctgctcgtcatcagcggcctgttcccggtgtccatccccatcaccgcggccgcctggtacctgtgggaggtgaagaagcagcgggccggggtcctctgggacgtgccctccccgccgcccatgggcaaggccgagctggaggacggggcgtaccgcatcaagcagaagggcgtgctggggtactcccagatcggcgccggcgtctacaaggaggggaccttccacacgatgtggcacgtgacccggggcgccgtgctcatgcacaaggggaagcgcatcgagcccagctgggccgacgtcaagaaggacctgatctcctacggcgggggctggaagctggagggcgagtggaaggagggggaggaggtccaggtgctcgccctggagcccggcaagaacccccgggcggtccagaccaagcccgggctgttcaagaccaacacgggcaccatcggggccgtgagcctcgacttctcccccggcaccagcggctcccccatcatcgacaagaaggggaaggtggtcggcctgtacgggaacggcgtggtgacccgcagcggcgcctacgtctccgccatcgcccagacggagaagtccatcgaggacaaccccgacatcgaggacgacatcttccggaagcgccggctgaccatcatggacctgcaccccggggcgggcaagaccaagcgctacctccccgccatcgtgcgggaggccatcaagcgcgggctgcggaccctgatcctcgccccgacgcgcgtggtcgcggccgagatggaggaggccctgcggggcctgcccatccgctaccagacccccgccatccgggccgagcacaccgggcgcgagatcgtggacctcatgtgccacgcgaccttcacgatgcgcctgctgtcccccgtgcgggtcccgaactacaacctcatcatcatggacgaggcccacttcaccgaccccgccagcatcgccgcccgcggctacatcagcacccgggtggagatgggcgaggcggccgggatcttcatgaccgccacgccgcccggctcccgcgacccgttcccccagagcaacgcccccatcatcgacgaggagcgggagatccccgagcgctcctggaacagcgggcacgagtgggtgaccgacttcaagggcaagaccgtctggttcgtgccgtccatcaaggccgggaacgacatcgcggcctgcctgcggaagaacggcaagaaggtgatccagctgagccgcaagaccttcgactccgagtacgtcaagacgcggaccaacgactgggacttcgtggtgaccaccgacatcagcgagatgggcgccaacttcaaggccgagcgcgtcatcgacccccggcgctgcatgaagcccgtgatcctcacggacggggaggagcgggtgatcctggcgggccccatgccggtcacccactccagcgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtggacgcgatcgacggcgagtaccggctgcgcggggaggcccgcaagaccttcgtggacctcatgcggcgcggcgacctgcccgtctggctggcctacaaggtggccgccgaggggatcaactacgcggaccggcgctggtgcttcgacggcatcaagaacaaccagatcctcgaggagaacgtcgaggtggagatctggacgaaggagggggagcggaagaagctgaagccgcgctggctggacgcccggatctacagcgaccccctcgccctgaaggagttcaaggagttcgccgccggccgcaagtccctgaccctcaacctgatcaccgagatgggccggctgcccaccttcatgacgcagaagacccgcgacgcgctcgacaacctggccgtgctgcacaccgccgaggccgggggccgggcgtacaaccacgccctcagcgagctgcccgagaccctggagacgctcctgctgctcaccctgctggccaccgtcaccgggggcatcttcctcttcctgatgtccggccgcgggatcggcaagatgaccctggggatgtgctgcatcatcacggccagcatcctcctgtggtacgcccagatccagccgcactggatcgcggcctccatcatcctggagttcttcctcatcgtgctgctgatccccgagcccgagaagcagcggacgccccaggacaaccagctcacctacgtggtcatcgccatcctgaccgtggtggccgccacgatggcgaacgagatgggcttcctggagaagaccaagaaggacctcgggctgggcagcatcaccacccagcagccggagtccaacatcctggacatcgacctccgccccgccagcgcctggacgctgtacgccgtcgccaccaccttcgtgacccccatgctgcggcacagcatcgagaactccagcgtgaacgtctccctcacggcgatcgccaaccaggccaccgtgctgatgggcctggggaagggctggcccctcagcaagatggacatcggggtgccgctgctggccatcggctgctactcccaggtcaaccccatcaccctcaccgccgcgctgctgctcctggtggcccactacgccatcatcgggcccggcctgcaggccaaggcgacgcgcgaggcccagaagcgggccgccgccggcatcatgaagaaccccaccgtggacgggatcaccgtcatcgacctcgacccgatcccctacgaccccaagttcgagaagcagctgggccaggtgatgctgctcgtgctgtgcgtcacccaggtgctgatgatgcgcacgacctgggcgatgtgcgaggccctcaccctggccaccgggcccatcagcacgctgtgggagggcaacccggggcggttctggaacaccaccatcgccgtgtccatggccaacatcttccgcggcagctacctcgcgggcgccgggctgctgttctccatcatgaagaacaccacgaacacccggcgcggcaccgggaacatcggcgagaccctcggcgagaagtggaagtcccgcctgaacgccctggggaagtccgagttccagatctacaagaagtccggcatccaggaggtcgaccggacgctcgccaaggaggggatcaagcgcggcgagaccgaccaccacgccgtgtcccgggggagcgcgaagctgcgctggttcgtggagcggaacatggtcacccccgagggcaaggtggtggacctgggctgcgggcgcggcgggtggtcctactactgcggcgggctcaagaacgtccgggaggtgaagggcctgaccaagggcgggcccggccacgaggagcccatcccgatgagcacgtacgggtggaacctggtgcgcctccagtccggcgtcgacgtgttcttcatcccgcccgagaagtgcgacaccctgctgtgcgacatcggggagagctcccccaacccgaccgtggaggccggccggaccctccgcgtcctgaacctggtggagaactggctcaacaacaacacccagttctgcatcaaggtgctgaacccctacatgcccagcgtcatcgagaagatggagacgctgcagcggaagtacggcggggccctggtgcgcaacccgctcagccggaactccacccacgagatgtactgggtgagcaacgcctccggcaacatcgtcagctccgtgaacatgatcagccgcatgctgatcaaccggttcaccatgcgccacaagaagaccacgtacgagcccgacgtggacctggggtccggcacccggaacatcgggatcgagagcgagatccccaacctcgacatcatcggcaagcgcatcgagaagatcaagcaggagcacgagacctcctggcactacgaccaggaccacccctacaagacctgggcgtaccacggcagctacgagacgaagcagaccgggtccgccagctccatggtcaacggcgtggtgcggctgctgaccaagccgtgggacgtcctccccaccgtgacgcagatggccatgaccgacaccacccccttcgggcagcagcgcgtgttcaaggagaaggtcgacacgcgcacccaggagcccaaggagggcaccaagaagctgatgaagatcaccgccgagtggctgtggaaggagctcggcaagaagaagacgccgcggatgtgcacccgcgaggagttcacccggaaggtgcgcagcaacgccgcgctgggggccatcttcaccgacgagaacaagtggaagtccgcccgggaggccgtcgaggacagccgcttctgggagctggtggacaaggagcggaagctccacctggagggcaagtgcgagacgtgcgtgtacaacatgatggggaagcgcgagaagaagctgggcgagttcgggaaggccaagggctcccgggcgatctggtacatgtggctcggcgcccgcttcctggagttcgaggccctggggttcctcaacgaggaccactggttcagccgggagaactccctgagcggcgtcgagggggagggcctgcacaagctcgggtacatcctgcgcgacgtgagcaagaaggagggcggcgccatgtacgccgacgacaccgcggggtgggacacccggatcaccctggaggacctcaagaacgaggagatggtgacgaaccacatggagggcgagcacaagaagctggccgaggccatcttcaagctgacctaccagaacaaggtcgtgcgcgtgcagcggcccacgccccgggggaccgtcatggacatcatctcccggcgcgaccagcggggcagcggccaggtggggacgtacggcctcaacaccttcaccaacatggaggcccagctgatccgccagatggagggggagggcgtgttcaagaacatccagcacctgaccgtcacggaggagatcgcggtgcagaactggctcgcccgggtggggcgcgagcgcctgtcccggatggccatcagcggcgacgactgcgtcgtgaagcccctggacgaccgcttcgcctccgccctcaccgcgctgaacgacatgggcaagatccggaaggacatccagcagtgggagccgagccgcgggtggaacgactggacccaggtgcccttctgctcccaccacttccacgagctgatcatgaaggacggccgggtcctcgtggtgccctgccgcaaccaggacgagctgatcgggcgggcccgcatcagccagggcgccgggtggtccctgcgggagaccgcctgcctcggcaagagctacgcccagatgtggtccctgatctacttccaccgccgggacctgcgcctcgcggccaacgccatctgcagcgccgtcccctcccactgggtgccgaccagccggacgacctggtccatccacgccaagcacgagtggatgaccaccgaggacatgctgacggtgtggaaccgcgtctggatccaggagaacccctggatggaggacaagacccccgtggagagctgggaggagatcccctacctgggcaagcgggaggaccagtggtgcgggtccctcatcggcctgaccagccgcgcgacctgggccaagaacatccagacggccatcaaccaggtgcggagcctgatcgggaacgaggagtacaccgactacatgccgtccatgaagcgcttccggcgcgaggaggaggaggccggcgtcctctggtga

SEQ ID NO: 9331 - RNA, 9876 nt, synthetic construct
  misc_feature 1..9876: note = derived and/or modified CDS sequence (opt1) from DENV-2__FJ639832__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgaggtccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtggtccggctgctcaccaagccgtgggacgtgctgcccaccgtgacccagatggccatgacggacaccacccccttcgggcagcagcgcgtcttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtcgaggactcccgcttctgggagctcgtggacaaggagcggaacctgcacctggagggcaagtgcgagacctgcgtctacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtgagcaagaaggagggcggcgccatgtacgccgacgacacggcggggtgggacacccggatcaccctcgaggacctgaagaacgaggagatggtcaccaaccacatggagggcgagcacaagaagctggccgaggccatcttcaagctcacgtaccagaacaaggtggtgcgcgtccagcggcccacgccccgggggaccgtgatggacatcatcagccggcgcgaccagcggggctccggccaggtggggacctacggcctgaacacgttcaccaacatggaggcccagctgatccgccagatggagggggagggcgtcttcaagaacatccagcacctcaccgtgaccgaggaggtggccgtccagaactggctggcgcgggtggggcgcgagcgcctgagccggatggccatctccggcgacgactgcgtggtcaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtgctggtcgtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtcccgaccagccgcacgacctggtccatccacgccaagcacgagtggatgaccaccgaggacatgctgaccgtgtggaaccgggtgtggatccgcgagaacccctggatggaggacaagacgcccgtcgagagctgggaggagatcccctacctcggcaagcgggaggaccagtggtgcgggtccctgatcggcctgaccagccgcgccacctgggcgaagaacatccaggccgccatcaaccaggtgcggtccctcatcgggaacgaggagtacaccgactacatgccgagcatgaagcgcttccggcgcgaggaggaggaggccggcgtgctgtggtga

SEQ ID NO: 9332 - RNA, 9876 nt, synthetic construct
  misc_feature 1..9876: note = derived and/or modified CDS sequence (opt1) from DENV-2__FJ687434__SS-prME
  source 1..9876: mol_type = other RNA
agcgtgggcatgatcatcatgctgatccccaccgtcatggccttccacctcaccacccgcaacggggagccccacatgatcgtgtccatccaggagaagggcaagagcctgctgttcaagaccgaggacggggtgaacatgtgcaccctcatggccatggacctgggcgagctgtgcgaggacaccatcacctacaagtgccccctcctgcggcagaacgagcccgaggacatcgactgctggtgcaactccaccagcacctgggtcacctacgggacgtgcaccaccaccggcgagcaccgccgggagaagcgctccgtggcgctggtgccccacgtcggcatggggctcgagacgcggaccgagacctggatgagctccgagggcgcctggaagcacgcccagcgcatcgagacctggatcctgcggcacccggggttcacgatcatggccgccatcctggcgtacaccatcggcaccacccacttccagcgcacgctcatcttcatcctgctgaccgccgtggcccccagcatgaccatgcggtgcatcgggatctccaaccgcgacttcgtggagggcgtcagcggcgggtcctgggtggacatcgtgctcgagcacggcagctgcgtcaccacgatggccaagaacaagcccaccctggacttcgagctgatcaagaccgaggcgaagcagcccgccaccctccggaagtactgcatcgaggcccgcctgacgaacaccaccaccgagtcccggtgccccacgcagggggagcccagcctgaaggaggagcaggacaagcgcttcgtgtgcaagcactccatggtggaccggggctggggcaacgggtgcggcctcttcgggaagggcgggatcgtgacctgcgccatgttcacgtgcaagaagaacatggagggcaagatcgtgcagcccgagaacctggagtacaccatcgtggtcacgccccacagcggcgaggagcacgccgtggggaacgacaccggcaagcacgggaaggagatcaaggtgaccccgcagtccagcatcaccgaggcggagctgaccggctacgggacggtcaccatggagtgcagcccccggaccagcctcgacttcaacgagatggtgctgctgcagatggagaacaaggcctggctcgtgcaccggcagtggttcctggacctgcccctcccctggctgccgggcgccgacacccagggcagcaactggatccagaaggagacgctggtcaccttcaagaacccccacgccaagaagcaggacgtggtcgtgctcgggtcccaggagggcgccatgcacaccgcgctgaccggggccacggagatccagatgagctccggcaacctgctgttcaccgggcacctgaagtgccgcctgcggatggacaagctccagctgaagggcatgagctactccatgtgcaccggcaagttcaaggtggtcaaggagatcgccgagacccagcacgggacgatcgtgatccgcgtgcagtacgagggcgacgggagcccctgcaagatccccttcgagatcatggacctggagaagcggtacgtcctcggccgcctgatcaccgtgaacccgatcgtgaccgagaaggactcccccgtcaacatcgaggccgagccgcccttcggcgacagctacatcatcatcggggtggagccgggccagctgaagctcaactggttcaagaaggggtccagcatcggccagatgttcgagaccacgatgcgcggggccaagcggatggcgatcctgggcgacaccgcctgggacttcggctccctcggcggggtgttcaccagcatcgggaaggccctccaccaggtcttcggggccatctacggggccgcgttctccggcgtgagctggaccatgaagatcctgatcggcgtgatcatcacgtggatcgggatgaactcccgcagcacctccctgagcgtctccctggtgctcgtgggcgtcgtgaccctgtacctgggggtgatggtccaggccgacagcggctgcgtggtgagctggaagaacaaggagctcaagtgcgggtccggcatcttcatcaccgacaacgtccacacgtggaccgagcagtacaagttccagcccgagagcccctccaagctggccagcgccatccagaaggcgcaggaggagggcatctgcgggatccggtccgtgacccgcctggagaacctcatgtggaagcagatcacccccgagctgaaccacatcctggccgagaacgaggtgaagctcacgatcatgaccggcgacatcaaggggatcatgcaggccggcaagcggagcctgcgcccgcagcccaccgagctgaagtactcctggaagacctgggggaaggccaagatgctcagcacggagtcccacaaccagaccttcctgatcgacggccccgagaccgccgagtgcccgaacaccaaccgggcgtggaacagcctggaggtcgaggactacggcttcggggtgttcacgaccaacatctggctcaagctgaaggagaagcaggacgccttctgcgactccaagctgatgagcgccgccatcaaggacaaccgcgccgtgcacgcggacatgggctactggatcgagtccgccctcaacgacacctggaagatcgagaaggccagcttcatcgaggtcaagaactgccactggcccaagtcccacaccctgtggagcaacggggtgctggagtccgagatgatcatccccaagaacctcgccggccccgtgagccagcacaactaccggccgggctaccacacccagatcgccgggccctggcacctgggcaagctggagatggacttcgacttctgcgacgggacgaccgtcgtggtgaccgaggactgcggcaaccgcgggcccagcctccggaccacgaccgcgtccggcaagctgatcaccgagtggtgctgccgcagctgcaccctgcccccgctccggtaccgcggcgaggacgggtgctggtacggcatggagatccggcccctgaaggagaaggaggagaacctggtcaactccctcgtgacggccgggcacggccaggtggacaacttcagcctgggggtcctgggcatggccctcttcctggaggagatgctgcgcacccgggtgggcaccaagcacgccatcctcctggtggcggtctccttcgtgaccctgatcacggggaacatgagcttcaaggacctcggccgcgtggtcgtgatggtgggggccaccatgaccgacgacatcggcatgggggtcacctacctggccctgctcgccgccttcaaggtgcggcccacgttcgcggccggcctgctgctccgcaagctgacctccaaggagctgatgatgaccaccatcggcatcgtgctcctgagccagtccacgatccccgagaccatcctggagctcaccgacgccctggccctggggatgatggtcctcaagatggtgcgcgacatggagaagtaccagctggccgtcaccatcatggcgatcctgtgcgtgccgaacgccgtgatcctccagaacgcctggaaggtcagctgcacgatcctggccgtggtgtccgtcagccccctgctcctgacctccagccagcagaagaccgactggatccccctggccctcaccatcaagggcctgaaccccacggcgatcttcctgaccaccctctcccggaccaacaagaagcgcagctggccgctgaacgaggccatcatggccgtggggatggtgtccatcctggccagctccctcctgaagaacgacatccccatgacgggccccctggtcgcgggcgggctcctgaccgtgtgctacgtgctgaccggccggagcgccgacctcgagctggagcgcgccaccgacgtcaagtgggaggaccaggccgagatcagcgggtccagccccatcctgtccatcacgatcagcgaggacggctccatgagcatcaagaacgaggaggaggagcagaccctcaccatcctgatccggaccgggctgctcgtgatctccggcctgttcccggtgagcatccccatcaccgccgcggcctggtacctgtgggaggtcaagaagcagcgcgccggcgtgctctgggacgtgcccagcccgccgcccatggggaaggccgagctggaggacggcgcctaccggatcaagcagcgcgggatcctgggctacagccagatcggggcgggcgtctacaaggagggcacgttccacaccatgtggcacgtgacccgcggggccgtgctcatgcacaagggcaagcgcatcgagccctcctgggccgacgtcaagaaggacctgatcagctacgggggcgggtggaagctggagggcgagtggaaggagggcgaggaggtccaggtgctcgccctggagcccgggaagaacccccgggccgtccagaccaagcccggcctgttcaagacgaacaccgggaccatcggcgcggtgtccctcgacttcagccccgggacctccggcagccccatcatcgacaagaagggcaaggtggtcgggctgtacggcaacggggtggtgacgcgctccggcgcctacgtcagcgccatcgcccagaccgagaagtccatcgaggacaaccccgacatcgaggacgacatcttccggaagcgccggctgaccatcatggacctgcaccccggcgccgggaagaccaagcgctacctccccgcgatcgtgcgggaggccatcaagcgcggcctgcggacgctgatcctcgccccgacccgcgtggtcgccgcggagatggaggaggccctgcgggggctgcccatccgctaccagacccccgccatccgcgccgagcacaccggccgggagatcgtggacctcatgtgccacgccacgttcaccatgcgcctgctgagccccgtgcgggtcccgaactacaacctcatcatcatggacgaggcgcacttcaccgaccccgccagcatcgccgcccgcgggtacatctccacccgggtggagatgggcgaggccgcgggcatcttcatgacggccacgccgcccgggagccgcgacccgttcccccagtccaacgcccccatcatcgacgaggagcgggagatccccgagcgcagctggaactccggccacgagtgggtgaccgacttcaaggggaagaccgtctggttcgtgccgagcatcaaggccggcaacgacatcgccgcgtgcctgcggaagaacgggaagaaggtgatccagctgtcccgcaagacgttcgacagcgagtacgtcaagacccggaccaacgactgggacttcgtggtgaccacggacatctccgagatgggcgccaacttcaaggccgagcgcgtcatcgacccccggcgctgcatgaagcccgtgatcctcaccgacggcgaggagcgggtgatcctggccgggcccatgccggtcacccacagctccgcggcccagcgccggggccgcatcgggcggaaccccaagaacgagaacgaccagtacatctacatgggcgagcccctggagaacgacgaggactgcgcccactggaaggaggccaagatgctcctggacaacatcaacacccccgaggggatcatcccgagcatgttcgagcccgagcgcgagaaggtggacgccatcgacggcgagtaccgcctgcggggcgaggcgcgcaagacgttcgtggacctcatgcggcgcggggacctgcccgtctggctggcctacaaggtggccgccgagggcatcaactacgccgaccggcgctggtgcttcgacgggatcaagaacaaccagatcctcgaggagaacgtcgaggtggagatctggaccaaggagggcgagcggaagaagctgaagccgcgctggctggacgcgcggatctactccgaccccctcgccctgaaggagttcaaggagttcgccgccgggcgcaagagcctgaccctcaacctgatcaccgagatgggccggctgcccacgttcatgacccagaagacccgcgacgccctcgacaacctggcggtgctgcacaccgccgaggccggcgggcgggcctacaaccacgcgctctccgagctgcccgagacgctggagaccctcctgctgctcaccctgctggccaccgtcaccggcgggatcttcctcttcctgatgagcggccgcggcatcgggaagatgacgctgggcatgtgctgcatcgtgaccgcctccatcctcctgtggtacgcccagatccagccgcactggatcgccgcgagcatcatcctggagttcttcctcatcgtgctgctgatccccgagcccgagaagcagcggacgccccaggacaaccagctcacctacgtcgtgatcgccatcctgacggtggtcgccgccaccatggccaacgagatggggttcctggagaagaccaagaaggacctcggcctggggtccatcgcgacccagcagccggagagcaacatcctggacatcgacctccgccccgccagcgcctggacgctgtacgccgtggccaccaccttcgtgacccccatgctgcggcactccatcgagaacagctccgtcaacgtgagcctcacggcgatcgccaaccaggccaccgtgctgatgggcctgggcaaggggtggcccctctccaagatggacatcggcgccccgctgctggccatcgggtgctacagccaggtcaaccccatcaccctcaccgcggccctgctgctcctggtggcccactacgccatcatcggccccgggctgcaggcgaaggccacgcgcgaggcccagaagcgggccgccgcgggcatcatgaagaaccccaccgtggacggcatcaccgtcatcgacctcgacccgatcccctacgaccccaagttcgagaagcagctggggcaggccatgctgctcgtgctgtgcgtgacccaggtcctgatgatgcgcacgacctgggccctctgcgaggccctgaccctggccaccggccccatctccacgctctgggaggggaacccgggccggttctggaacaccaccatcgcggtgagcatggccaacatcttccgcgggtcctacctggccggcgccggcctcctgttcagcatcatgaagaacaccacgaactcccgccgggggaccggcaacatcggggagaccctgggcgagaagtggaagtcccgcctgaacgccctcggcaagtccgagttccagatctacaagaagtccgggatccaggaggtggaccggaccctggcgaaggagggcatcaagcgcggggagacggaccaccacgccgtctcccggggcagcgccaagctgcgctggttcgtggagcggaacatggtgacccccgaggggaaggtcgtggacctcggctgcggccgcgggggctggtcctactactgcgggggcctgaagaacgtgcgggaggtcaaggggctgaccaagggcggccccgggcacgaggagcccatcccgatgagcacctacggctggaacctcgtgcgcctgcagtccggggtggacgtcttcttcatcccgcccgagaagtgcgacacgctgctctgcgacatcggcgagagcagccccaacccgaccgtggaggccgggcggaccctgcgcgtgctgaacctcgtcgagaactggctgaacaacaacacccagttctgcatcaaggtgctgaacccctacatgccctccgtgatcgagaagatggagaccctgcagcggaagtacggcggcgcgctcgtccgcaacccgctgagccggaactccacgcacgagatgtactgggtgagcaacgcctccgggaacatcgtgagctccgtcaacatgatcagccgcatgctgatcaaccggttcaccatgcgccacaagaaggccacctacgagcccgacgtggacctcggctccgggacccggaacatcggcatcgagagcgagatccccaacctggacatcatcgggaagcgcatcgagaagatcaagcaggagcacgagacgtcctggcactacgaccaggaccacccctacaagacctgggcctaccacggcagctacgagaccaagcagaccggctccgccagctccatggtgaacggggtcgtgcgcctgctcacgaagccgtgggacgtgctgcccaccgtcacccagatggcgatgaccgacacgacccccttcggccagcagcgggtgttcaaggagaaggtggacacccgcacccaggagcccaaggaggggacgaagaagctgatgaagatcaccgccgagtggctctggaaggagctgggcaagaagaagaccccgcggatgtgcacccgcgaggagttcacgcggaaggtccgcagcaacgccgccctgggcgccatcttcaccgacgagaacaagtggaagtccgcgcgggaggccgtggaggacagccgcttctgggagctcgtcgacaaggagcggaacctgcacctggaggggaagtgcgagacctgcgtgtacaacatgatgggcaagcgcgagaagaagctcggggagttcggcaaggccaaggggtcccgggccatctggtacatgtggctgggcgcccgcttcctggagttcgaggcgctcggcttcctgaacgaggaccactggttcagccgggagaacagcctgtccggggtggagggcgaggggctccacaagctgggctacatcctgcgcgacgtcagcaagaaggagggcggggccatgtacgccgacgacaccgccggctgggacacgcggatcaccctcgaggacctgaagaacgaggagatggtgaccaaccacatggagggggagcacaagaagctggcggaggccatcttcaagctcacctaccagaacaaggtggtccgcgtgcagcggcccacgccccgcggcaccgtgatggacatcatctcccggcgcgaccagcgggggagcggccaggtcgggacctacggcctgaacaccttcacgaacatggaggcccagctgatccgccagatggagggcgagggggtgttcaagaacatccagcacctcaccgtgaccgaggagatcgccgtccagaactggctggcccgcgtgggccgggagcgcctgtcccggatggcgatcagcggggacgactgcgtggtcaagcccctcgacgaccgcttcgcctccgccctgaccgccctgaacgacatgggcaagatccggaaggacatccagcagtgggagccgagccgcggctggaacgactggacccaggtgcccttctgctcccaccacttccacgagctcatcatgaaggacgggcgggtgctggtcgtgccctgccgcaaccaggacgagctgatcggccgggcccgcatcagccagggggcgggctggtccctccgggagaccgcctgcctgggcaagagctacgcccagatgtggtccctgatgtacttccaccgccgggacctccgcctggccgccaacgcgatctgcagcgccgtgccctcccactgggtcccgaccagccggaccacctggtccatccacgccaagcacgagtggatgacgaccgaggacatgctgaccgtgtggaaccgcgtgtggatccaggagaacccctggatggaggacaagacccccgtcgagagctgggaggagatcccctacctcggcaagcgggaggaccagtggtgcggcagcctgatcgggctgacgtcccgcgccacctgggccaagaacatccaggcggccatcaaccaggtgcggagcctcatcggcaacgaggagtacaccgactacatgccgtccatgaagcgcttccgccgggaggaggaggaggccggggtgctgtggtga

SEQ ID NO: 9333 - RNA, 9876 nt, synthetic construct
  misc_feature 1..9876: note = derived and/or modified CDS sequence (opt1) from DENV-2__FJ687439__SS-prME
  source 1..9876: mol_type = other RNA
agcgccgggatgatcatcatgctgatccccaccgtgatggccttccacctcaccacccgcaacggggagccccacatgatcgtcgggatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcggcctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcaggagtccaactggatccagaaggagaccctggtgaccttcaagaacccccacgcgaagaagcaggacgtcgtggtcctcggcagccaggagggggccatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgctacgtgctcggccggctgatcaccgtcaacccgatcgcgacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgccaagcgcatggccatcctgggcgacaccgcctgggacttcgggtccctgggcggggtcttcacgagcatcggcaaggcgctccaccaggtgttcggggccatctacggcgccgccttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggcggacagcgggtgcgtggtgtcctggaagaacaaggagctcaagtgcggcagcggcatcttcatcaccgacaacgtccacacctggaccgagcagtacaagttccagcccgagagcccctccaagctggccagcgccatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggcggggaagcgcagcctgcggccgcagcccacggagctgaagtactcctggaagacctggggcaaggccaagatgctcagcaccgagtcctacaaccagaccttcctgatcgacggccccgagacggccgagtgcccgaacaccaaccgcgcctggaacagcctggaggtcgaggactacgggttcggcgtgttcaccaccaacatctggctcaagctgaaggagaagcaggacgccttctgcgactccaagctgatgagcgcggccatcaaggacaaccgggccgtgcacgccgacatggggtactggatcgagtccgccctcaacgacacgtggaagatcgagaaggcgagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgccggcccctggcacctggggaagctggagatggacttcgacttctgcgacggcaccaccgtcatcgtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtcaccgcgggccacggccaggtggacaacttcagcctgggcgtgctgggcatggccctcttcctggaggagatgctgcggacccgcgtcgggacgaagcacgccatcctcctggtggccgtgtccttcgtcaccctgatcaccggcaacatgagcttcaaggacctcgggcgggtggtggtcatggtgggcgccaccatggcggacgacatcgggatgggcgtgacgtacctggccctgctcgccgccttcaaggtccgccccaccttcgccgcgggcctgctgctccggaagctgacctccaaggagctgatgatgaccacgatcgggatcgtgctcctgagccagtccaccatccccgagaccatcctggagctcaccgacgccctggccctgggcatgatggtgctcaagatcgtccgcaacatggagaagtaccagctggccgtgacgatcatggccatcctgtgcgtgccgaacgcggtcatcctccagaacgcctggaaggtgagctgcaccatcctggccgtcgtgtccgtgagccccctgctcctgacctccagccagcagaagaccgactggatccccctggccctcacgatcaaggggctgaaccccaccgcgatcttcctgaccaccctctcccgcacgaacaagaagcggagctggccgctgaacgaggccatcatggccgtcggcatggtgtccatcctggccagctccctcctgaagaacgacatccccatgaccggccccctggtggccgggggcctcctgaccgtctgctacgtgctgaccgggcgcagcgcggacctcgagctggagcgggccacggacgtgaagtgggaggaccaggccgagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcgtggtacctgtgggaggtgaagaagcagcgggccggggtgctctgggacgtccccagcccgccgcccatgggcaaggccgagctggaggacggggcctaccgcatcaagcagaagggcatcctggggtacagccagatcggcgccggcgtgtacaaggaggggaccttccacaccatgtggcacgtgacccggggcgcggtcctcatgcacaaggggaagcgcatcgagccctcctgggccgacgtgaagaaggacctgatcagctacggcgggggctggaagctggagggcgagtggaaggagggggaggaggtgcaggtcctcgccctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcgtacgtgagcgccatcgcccagaccgagaagtccatcgaggacaaccccgagatcgaggacgacatcttccggaagcgccggctgaccatcatggacctgcaccccggggccggcaagacgaagcgctacctccccgcgatcgtgcgggaggccatcaagcgcgggctgcggaccctgatcctcgccccgacccgcgtcgtggccgccgagatggaggaggcgctgcggggcctgcccatccgctaccagacccccgccatccgggccgagcacacggggcgcgagatcgtggacctcatgtgccacgccaccttcaccatgcgcctgctgagccccgtccgggtgccgaactacaacctcatcgtgatggacgaggcccacttcaccgaccccgcgtccatcgccgcccgcggctacatcagcacgcgggtcgagatgggcgaggccgccgggatcttcatgaccgcgacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggccgggaacgacatcgccgcgtgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggccgagcgcgtgatcgacccccggcgctgcatgaagcccgtcatcctcaccgacggggaggagcgggtgatcctggccggccccatgccggtgacccacagctccgccgcgcagcgccgggggcgcatcggccggaaccccaagaacgagaacgaccagtacatctacatgggggagcccctggagaacgacgaggactgcgcccactggaaggaggccaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcgtacaaggtcgccgccgaggggatcaactacgccgaccggcgctggtgcttcgacggcatcaagaacaaccagatcctcgaggagaacgtggaggtggagatctggaccaaggagggggagcggaagaagctgaagccgcgctggctggacgcccggatctactccgaccccctcgcgctgaaggagttcaaggagttcgccgccggccgcaagagcctgaccctcaacctgatcacggagatgggccggctgcccaccttcatgacccagaagacccgcgacgccctcgacaacctggcggtcctgcacacggccgaggccgggggccgggcctacaaccacgccctctccgagctgcccgagaccctggagaccctcctgctgctcaccctgctggcgacggtgaccgggggcatcttcctcttcctgatgagcggccgcgggatcggcaagatgaccctggggatgtgctgcatcatcaccgcctccatcctcctgtggtacgcccagatccagccgcactggatcgccgccagcatcatcctggagttcttcctcatcgtcctgctgatccccgagcccgagaagcagcggacgccccaggacaaccagctcacgtacgtggtgatcgcgatcctgaccgtcgtggccgccaccatggccaacgagatgggcttcctggagaagaccaagaaggacctcgggctgggctccatcgccacgcagcagccggagagcaacatcctggacatcgacctccgccccgcgtccgcctggaccctgtacgccgtggccaccaccttcgtcacgcccatgctgcggcacagcatcgagaacagctccgtgaacatcagcctcaccgccatcgcgaaccaggccaccgtgctgatgggcctggggaagggctggcccctctccaagatggacatcggggtcccgctgctggccatcggctgctacagccaggtgaaccccatcaccctcacggccgcgctgctgctcctggtggcccactacgccatcatcgggcccggcctgcaggccaaggccacccgcgaggcgcagaagcgggccgccgccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggcgctgaccctggccacggggcccatctccaccctctgggagggcaacccggggcggttctggaacaccaccatcgccgtgagcatggccaacatcttccgcggctcctacctggccggcgcggggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtcgaccggaccctggccaaggaggggatcaagcgcggcgagaccgaccaccacgccgtgagccgggggtccgcgaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggccctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggcgacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcctccagcatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgcggccctgggggccatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggcgaagggcagccgggccatctggtacatgtggctgggcgcccgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgcgatgtacgccgacgacacggccgggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtggggacctacggcctgaacacgttcaccaacatggaggcgcagctgatccgccagatggagggggagggcgtgttcaagaacatccagcacctcaccgtcaccgaggaggtggccgtgcagaactggctggcccgggtcgggcgcgagcgcctgagccggatggccatctccggcgacgactgcgtggtgaagcccctcgacgaccgcttcgccaacgcgctgacggccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcccggatcagccagggcgccgggtggtccctccgcgagaccgcctgcctgggcaagagctacgcgcagatgtggtccctgatgtacttccaccggcgcgacctccggctggccgccaacgccatctgcagcgccgtgccctcccactgggtgccgaccagccgcacgacctggtccatccacgcgaagcacgagtggatgaccaccgaggacatgctgaccgtctggaaccgggtgtggatccgcgagaacccctggatggaggacaagacgcccgtggagagctgggaggagatcccctacctcggcaagcgggaggaccagtggtgcgggtccctgatcggcctgaccagccgcgccacctgggccaagaacatccaggccgcgatcaaccaggtccggtccctcatcgggaacgaggagtacaccgactacatgccgagcatgaagcgcttccggcgcgaggaggaggaggccggcgtgctgtggtga

SEQ ID NO: 9334 - RNA, 9876 nt, synthetic construct
  misc_feature 1..9876: note = derived and/or modified CDS sequence (opt1) from DENV-2__FJ687440__SS-prME
  source 1..9876: mol_type = other RNA
agcgccggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctggatcacctacgggacctgcaccaccaccggcgagcaccgccgggagaagcgcagcgtggccctggtcccccacgtggggatgggcctcgagacccggaccgagacctggatgtccagcgagggggcctggaagcacgcccagcgcatcgagacctggatcctgcggcacccgggcttcaccatcatggccgcgatcctggcctacaccatcgggaccacccacttccagcgcgccctcatcttcatcctgctgacggccgtggcgccctccatgaccatgcggtgcatcggcatcagcaaccgcgacttcgtcgagggcgtgtccgggggcagctgggtggacatcgtcctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtcgaccgcggctgggggaacggctgcgggctgttcggcaagggcgggatcgtgacgtgcgcgatgttcacgtgcaagaagaacatggagggcaagatcgtgcagcccgagaacctggagtacaccatcgtcgtgacgccccactccggggaggagcacgccgtgggcaacgacacggggaagcacggcaaggagatcaaggtcaccccgcagagctccatcaccgaggccgagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcagggctccaactggatccagaaggagaccctggtgaccttcaagaacccccacgcgaagaagcaggacgtggtcgtgctcgggagccaggagggcgccatgcacacggccctgaccggggccaccgagatccagatgagctccggcaacctcctgttcaccggccacctgaagtgccggctgcgcatggacaagctccagctgaaggggatgagctactccatgtgcacgggcaagttcaaggtcgtgaaggagatcgccgagacccagcacgggaccatcgtgatccgggtccagtacgagggcgacggcagcccctgcaagatccccttcgagatcatggacctggagaagcgctacgtgctcgggcggctgatcaccgtgaacccgatcgtcacggagaaggactcccccgtgaacatcgaggcggagccgcccttcggcgacagctacatcatcatcggggtggagccgggccagctgaagctcaactggttcaagaaggggtccagcatcggccagatgttcgagaccaccatgcgcggcgccaagcgcatggccatcctgggggacaccgcctgggacttcggctccctcggcggggtcttcacgagcatcgggaaggccctccaccaggtgttcggcgcgatctacggcgccgccttctccggggtgagctggaccatgaagatcctgatcggcgtcatcatcacctggatcgggatgaactcccggagcacctccctgagcgtgtccctggtgctcgtcggcatcgtgacgctgtacctgggggtgatggtccaggccgacagcggctgcgtggtgtcctggaagaacaaggagctcaagtgcggcagcgggatcttcatcaccgacaacgtccacacctggaccgagcagtacaagttccagcccgagagcccctccaagctggcgagcgccatccagaaggcccaggaggagggcatctgcgggatccgctccgtgacgcggctggagaacctcatgtggaagcagatcacccccgagctgaaccacatcctggccgagaacgaggtgaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtcgaggactacggcttcggggtgttcaccaccaacatctggctcaagctgaaggagaagcaggacgccttctgcgactccaagctgatgagcgccgcgatcaaggacaaccgggccgtgcacgccgacatgggctactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgcggggcccgtgagccagcacaactaccgcccgggctaccacacccagatcgccgggccctggcacctgggcaagctggagatggacttcgacttctgcgacgggaccaccgtcatcgtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtgaactccctcgtcaccgccgggcacggccaggtggacaacttcagcctgggcgtgctggggatggccctgttcctggaggagatgctgcggacccgcgtcggcacgaagcacgccatcctcctggtggccgtgtccttcgtcaccctgatcaccgggaacatgagcttcaaggacctcggccgggtggtggtcatggtgggggccaccatgacggacgacatcggcatgggcgtgacctacctggccctgctcgcggccttcaaggtccgccccaccttcgccgccgggctgctgctccggaagctgacctccaaggagctgatgatgacgaccatcggcatcgtgctcctgagccagtccaccatccccgagaccatcctggagctcacggacgccctggcgctggggatgatggtgctcaagatcgtccgcaacatggagaagtaccagctggccgtgaccatcatggccatcctgtgcgtgccgaacgccgtcatcctccagaacgcctggaaggtgagctgcaccatcctggcggtcgtgtccgtgagccccctgctcctgacctccagccagcagaagacggactggatccccctggccctcaccatcaagggcctgaaccccaccgccatcttcctgaccacgctctcccgcaccaacaagaagcggagctggccgctgaacgaggccatcatggcggtcggcatggtgtccatcctggccagctccctcctgaagaacgacatccccatgaccgggcccctggtggccggcgggctcctgaccgtctgctacgtgctgacgggccgcagcgccgacctcgagctggagcgggccaccgacgtgaagtgggaggaccaggcggagatctccgggagcagccccatcctgtccatcaccatcagcgaggacggctccatgagcatcaagaacgaggaggaggagcagaccctcacgatcctgatccgcaccggcctgctcgtcatctccgggctgttcccggtgagcatccccatcaccgccgccgcctggtacctgtgggaggtgaagaagcagcgggccggcgtcctctgggacgtgcccagcccgccgcccatggggaaggcggagctggaggacggcgcctaccgcatcaagcagaaggggatcctgggctacagccagatcggcgccggggtgtacaaggagggcaccttccacaccatgtggcacgtcacgcgcggggcggtgctcatgcacaagggcaagcgcatcgagccctcctgggccgacgtgaagaaggacctgatcagctacgggggcggctggaagctggagggggagtggaaggagggcgaggaggtccaggtgctcgcgctggagcccgggaagaacccccgggccgtgcagaccaagcccggcctgttcaagaccaacaccgggacgatcggcgccgtctccctcgacttcagccccggcacctccgggagccccatcatcgacaagaagggcaaggtggtggggctgtacggcaacggcgtcgtgacccgctccggggcctacgtgagcgccatcgcgcagaccgagaagtccatcgaggacaaccccgagatcgaggacgacatcttccggaagcgccggctgacgatcatggacctgcaccccggcgccgggaagaccaagcgctacctccccgccatcgtccgggaggccatcaagcgcggcctgcggaccctgatcctcgcgccgacccgcgtggtggccgccgagatggaggaggccctgcgggggctgcccatccgctaccagacgcccgccatccgggcggagcacaccggccgcgagatcgtcgacctcatgtgccacgccaccttcaccatgcgcctgctgagccccgtgcgggtgccgaactacaacctcatcatcatggacgaggcccacttcacggaccccgcctccatcgccgcgcgcggctacatcagcacccgggtcgagatgggggaggccgccggcatcttcatgaccgccacgccgcccgggagccgcgacccgttcccccagtccaacgcccccatcatcgacgaggagcgggagatccccgagcgcagctggaactccggccacgagtgggtgacggacttcaccgggaagaccgtgtggttcgtcccgagcatcaaggcgggcaacgacatcgccgcctgcctgcggaagaacggcaagaaggtgatccagctgtcccgcaagaccttcgacagcgagtacgtgaagacgcggaccaacgactgggacttcgtcgtgaccaccgacatctccgagatgggggccaacttcaaggcggagcgcgtgatcgacccccggcgctgcatgaagcccgtcatcctcacggacggcgaggagcgggtgatcctggccgggcccatgccggtgacccacagctccgccgcccagcgccggggccgcatcgggcggaaccccaagaacgagaacgaccagtacatctacatgggcgagcccctggagaacgacgaggactgcgcccactggaaggaggcgaagatgctcctggacaacatcaacacccccgagggcatcatcccgagcatgttcgagcccgagcgcgagaaggtcgacgccatcgacggggagtaccggctgcgcggcgaggcccgcaagaccttcgtggacctcatgcggcgcggggacctgcccgtgtggctggcctacaaggtcgccgcggagggcatcaactacgccgaccggcgctggtgcttcgacgggatcaagaacaaccagatcctcgaggagaacgtggaggtggagatctggacgaaggagggcgagcggaagaagctgaagccgcgctggctggacgcccggatctactccgaccccctcgccctgaaggagttcaaggagttcgccgcgggccgcaagagcctgaccctcaacctgatcaccgagatggggcggctgcccaccttcatgacgcagaagacccgcgacgccctcgacaacctggccgtcctgcacaccgccgaggcgggcgggcgggcctacaaccacgccctctccgagctgcccgagaccctggagacgctcctgctgctcaccctgctggccaccgtgaccggcggcatcttcctcttcctgatgagcgggcgcggcatcgggaagatgaccctgggcatgtgctgcatcatcacggcctccatcctcctgtggtacgcgcagatccagccgcactggatcgccgccagcatcatcctggagttcttcctcatcgtcctgctgatccccgagcccgagaagcagcggacgccccaggacaaccagctcacctacgtggtgatcgccatcctgaccgtcgtggccgcgacgatggccaacgagatggggttcctggagaagaccaagaaggacctcggcctgggctccatcgccacccagcagccggagagcaacatcctggacatcgacctccgccccgcctccgcctggaccctgtacgcggtggccacgaccttcgtcacccccatgctgcggcacagcatcgagaacagctccgtgaacgtgagcctcaccgccatcgccaaccaggccacggtcctgatggggctgggcaaggggtggcccctctccaagatggacatcggcgtgccgctgctggcgatcgggtgctacagccaggtgaaccccatcaccctcaccgccgccctgctgctcctggtcgcccactacgcgatcatcggccccggcctgcaggccaaggccacccgcgaggcccagaagcgggccgcggccgggatcatgaagaaccccacggtggacggcatcaccgtgatcgacctcgacccgatcccctacgaccccaagttcgagaagcagctggggcaggtcatgctgctcatcctgtgcgtgacccaggtgctgatgatgcgcaccacgtgggccctctgcgaggccctgaccctggccaccggccccatctccaccctctgggaggggaacccgggccggttctggaacacgaccatcgcggtcagcatggccaacatcttccgcggctcctacctggccggggccggcctcctcttcagcatcatgaagaacaccaccaacacgcggcgcgggaccggcaacatcggcgagaccctgggggagaagtggaagtcccgcctgaacgccctcggcaagagcgagttccagatctacaagaagtccgggatccaggaggtggaccggaccctggcgaaggagggcatcaagcgcggggagacggaccaccacgccgtgagccggggctccgccaagctgcgctggttcgtcgagcggaacatggtgacccccgagggcaaggtggtcgacctcgggtgcggccgcgggggctggagctactactgcgggggcctgaagaacgtgcgggaggtgaagggcctgaccaagggcggccccgggcacgaggagcccatcccgatgtccacctacggctggaacctcgtccgcctgcagagcggggtggacgtgttcttcatcccgcccgagaagtgcgacacgctgctctgcgacatcggcgagtccagccccaacccgaccgtcgaggccggccggaccctgcgcgtgctgaacctcgtggagaactggctgaacaacaacacccagttctgcatcaaggtcctgaacccctacatgccctccgtgatcgagaagatggaggcgctgcagcggaagtacgggggcgccctcgtgcgcaacccgctgagccggaacagcacccacgagatgtactgggtctccaacgccagcgggaacatcgtgtccagcgtgaacatgatctcccgcatgctgatcaaccggttcacgatgcgccacaagaaggccacctacgagcccgacgtcgacctcggcagcgggacccggaacatcggcatcgagtccgagatccccaacctggacatcatcggcaagcgcatcgagaagatcaagcaggagcacgagaccagctggcactacgaccaggaccacccctacaagacgtgggcctaccacgggtcctacgagaccaagcagaccggcagcgcgtccagcatggtgaacggggtggtccggctgctcaccaagccgtgggacgtgctgcccacggtgacccagatggccatgaccgacaccacgcccttcggccagcagcgcgtcttcaaggagaaggtggacacccgcacccaggagcccaaggagggcaccaagaagctgatgaagatcacggccgagtggctctggaaggagctggggaagaagaagaccccgcggatgtgcacccgcgaggagttcacccggaaggtgcgctccaacgccgccctgggcgcgatcttcacggacgagaacaagtggaagtccgcccgggaggccgtcgaggactcccgcttctgggagctcgtggacaaggagcggaacctgcacctggaggggaagtgcgagacctgcgtgtacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgtccggggtcgagggcgaggggctccacaagctgggctacatcctgcgcgacgtgagcaagaaggagggcggggccatgtacgccgacgacaccgcgggctgggacacccggatcacgctcgaggacctgaagaacgaggagatggtcaccaaccacatggagggggagcacaagaagctggccgaggccatcttcaagctcacctaccagaacaaggtggtgcgcgtccagcggcccacgccccggggcacggtgatggacatcatcagccggcgcgaccagcgggggtccggccaggtgggcacctacgggctgaacaccttcaccaacatggaggcccagctgatccgccagatggagggcgagggggtcttcaagaacatccagcacctcacggccaccgaggagatcgcggtgcagaactggctggcccgggtgggccgcgagcgcctgagccggatggccatctccggcgacgactgcgtcgtgaagcccctcgacgaccgcttcgccaacgccctgaccgcgctgaacgacatggggaagatccggaaggacatccagcagtgggagccgagcaagggctggaacgactggacccaggtgcccttctgctcccaccacttccacgagctcatcatgaaggacgggcgcgtcctggtggtgccctgccggaaccaggacgagctgatcggccgcgcccggatcagccagggggccggctggtccctccgcgagacggcctgcctgggcaagagctacgcccagatgtggtccctgatgtacttccaccggcgcgacctccggctggcggccaacgccatctgcagcgccgtcccctcccactgggtgccgaccagccgcaccacctggtccatccacgccaagcacgagtggatgaccacggaggacatgctgaccgtgtggaaccgggtctggatccgcgagaacccctggatggaggacaagacccccgtggagagctgggaggagatcccctacctcgggaagcgggaggaccagtggtgcggctccctgatcgggctgaccagccgcgcgacgtgggccaagaacatccaggccgccatcaaccaggtgcggtccctcatcggcaacgaggagtacaccgactacatgccgagcatgaagcgcttccggcgcgaggaggaggaggcgggggtcctgtggtga

SEQ ID NO: 9335 - RNA, 9876 nt, synthetic construct
  misc_feature 1..9876: note = derived and/or modified CDS sequence (opt1) from DENV-2__FJ687441__SS-prME
  source 1..9876: mol_type = other RNA
agcgccggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctggatcacctacgggacctgcaccaccaccggcgagcaccgccgggagaagcgcagcgtggccctggtcccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtggcgccctccatgaccatgcggtgcatcggcatcagcaaccgcgacttcgtcgagggcgtgtccgggggcagctgggtggacatcgtcctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtcgaccgcggctgggggaacggctgcgggctgttcggcaagggcgggatcgtgacgtgcgcgatgttcacgtgcaagaagaacatggagggcaagatcgtgcagcccgagaacctggagtacaccatcgtcgtgacgccccactccggggaggagcacgccgtgggcaacgacacggggaagcacggcaaggagatcaaggtcaccccgcagagctccatcaccgaggccgagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcagggctccaactggatccagaaggagaccctggtgaccttcaagaacccccacgcgaagaagcaggacgtggtcgtgctcgggagccaggagggcgccatgcacacggccctgaccggggccaccgagatccagatgagctccggcaacctcctgttcaccggccacctgaagtgccggctgcgcatggacaagctccagctgaaggggatgagctactccatgtgcacgggcaagttcaaggtcgtgaaggagatcgccgagacccagcacgggaccatcgtgatccgggtccagtacgagggcgacggcagcccctgcaagatccccttcgagatcatggacctggagaagcgctacgtgctcgggcggctgatcaccgtgaacccgatcgtcacggagaaggactcccccgtgaacatcgaggcggagccgcccttcggcgacagctacatcatcatcggggtggagccgggccagctgaagctcaactggttcaagaaggggtccagcatcggccagatgttcgagaccaccatgcgcggcgccaagcgcatggccatcctgggggacaccgcctgggacttcggctccctcggcggggtcttcacgagcatcgggaaggccctccaccaggtgttcggcgcgatctacggcgccgccttctccggggtgagctggaccatgaagatcctgatcggcgtcatcatcacctggatcgggatgaactcccggagcacctccctgagcgtgtccctggtgctcgtcggcatcgtgacgctgtacctgggggtgatggtccaggccgacagcggctgcgtggtgtcctggaagaacaaggagctcaagtgcggcagcgggatcttcatcaccgacaacgtccacacctggaccgagcagtacaagttccagcccgagagcccctccaagctggcgagcgccatccagaaggcccaggaggagggcatctgcgggatccgctccgtgacgcggctggagaacctcatgtggaagcagatcacccccgagctgaaccacatcctggccgagaacgaggtgaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtcgaggactacggcttcggggtgttcaccaccaacatctggctcaagctgaaggagaagcaggacgccttctgcgactccaagctgatgagcgccgcgatcaaggacaaccgggccgtgcacgccgacatgggctactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgcggggcccgtgagccagcacaactaccgcccgggctaccacacccagatcgccgggccctggcacctgggcaagctggagatggacttcgacttctgcgacgggaccaccgtcatcgtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtgaactccctcgtcaccgccgggcacggccaggtggacaacttcagcctgggcgtgctggggatggccctgttcctggaggagatgctgcggacccgcgtcggcacgaagcacgccatcctcctggtggccgtgtccttcgtcaccctgatcaccgggaacatgagcttcaaggacctcggccgggtggtggtcatggtgggggccaccatgacggacgacatcggcatgggcgtgacctacctggccctgctcgcggccttcaaggtccgccccaccttcgccgccgggctgctgctccggaagctgacctccaaggagctgatgatgacgaccatcggcatcgtgctcctgagccagtccaccatccccgagaccatcctggagctcacggacgccctggcgctggggatgatggtgctcaagatcgtccgcaacatggagaagtaccagctggccgtgaccatcatggccatcctgtgcgtgccgaacgccgtcatcctccagaacgcctggaaggtgagctgcaccatcctggcggtcgtgtccgtgagccccctgctcctgacctccagccagcagaagacggactggatccccctggccctcaccatcaagggcctgaaccccaccgccatcttcctgaccacgctctcccgcaccaacaagaagcggagctggccgctgaacgaggccatcatggcggtcggcatggtgtccatcctggccagctccctcctgaagaacgacatccccatgaccgggcccctggtggccggcgggctcctgaccgtctgctacgtgctgacgggccgcagcgccgacctcgagctggagcgggccaccgacgtgaagtgggaggaccaggcggagatctccgggagcagccccatcctgtccatcaccatcagcgaggacggctccatgagcatcaagaacgaggaggaggagcagaccctcacgatcctgatccgcaccggcctgctcgtcatctccgggctgttcccggtgagcatccccatcaccgccgccgcctggtacctgtgggaggtgaagaagcagcgggccggcgtcctctgggacgtgcccagcccgccgcccatggggaaggcggagctggaggacggcgcctaccgcatcaagcagaaggggatcctgggctacagccagatcggcgccggggtgtacaaggagggcaccttccacaccatgtggcacgtcacgcgcggggcggtgctcatgcacaagggcaagcgcatcgagccctcctgggccgacgtgaagaaggacctgatcagctacgggggcggctggaagctggagggggagtggaaggagggcgaggaggtccaggtgctcgcgctggagcccgggaagaacccccgggccgtgcagaccaagcccggcctgttcaagaccaacaccgggacgatcggcgccgtctccctcgacttcagccccggcacctccgggagccccatcatcgacaagaagggcaaggtggtggggctgtacggcaacggcgtcgtgacccgctccggggcctacgtgagcgccatcgcgcagaccgagaagtccatcgaggacaaccccgagatcgaggacgacatcttccggaagcgccggctgacgatcatggacctgcaccccggcgccgggaagaccaagcgctacctccccgccatcgtccgggaggccatcaagcgcggcctgcggaccctgatcctcgcgccgacccgcgtggtggccgccgagatggaggaggccctgcgggggctgcccatccgctaccagacgcccgccatccgggcggagcacaccggccgcgagatcgtcgacctcatgtgccacgccaccttcaccatgcgcctgctgagccccgtgcgggtgccgaactacaacctcatcatcatggacgaggcccacttcacggaccccgcctccatcgccgcgcgcggctacatcagcacccgggtcgagatgggggaggccgccggcatcttcatgaccgccacgccgcccgggagccgcgacccgttcccccagtccaacgcccccatcatcgacgaggagcgggagatccccgagcgcagctggaactccggccacgagtgggtgacggacttcaaggggaagaccgtgtggttcgtcccgagcatcaaggcgggcaacgacatcgccgcctgcctgcggaagaacggcaagaaggtgatccagctgtcccgcaagaccttcgacagcgagtacgtgaagacccggacgaacgactgggacttcgtcgtgaccaccgacatctccgagatgggggccaacttcaaggcggagcgcgtgatcgacccccggcgctgcatgaagcccgtcatcctcaccgacggcgaggagcgggtgatcctggccgggcccatgccggtgacgcacagctccgccgcccagcgccggggccgcatcgggcggaaccccaagaacgagaacgaccagtacatctacatgggcgagcccctggagaacgacgaggactgcgcccactggaaggaggcgaagatgctcctggacaacatcaacacccccgagggcatcatcccgagcatgttcgagcccgagcgcgagaaggtcgacgccatcgacggggagtaccggctgcgcggcgaggcccgcaagaccttcgtggacctcatgcggcgcggggacctgcccgtgtggctggcctacaaggtcgccgcggagggcatcaactacgccgaccggcgctggtgcttcgacgggatcaagaacaaccagatcctcgaggagaacgtggaggtggagatctggaccaaggagggcgagcggaagaagctgaagccgcgctggctggacgcccggatctactccgaccccctcgccctgaaggagttcaaggagttcgccgcgggccgcaagagcctgacgctcaacctgatcaccgagatggggcggctgcccaccttcatgacccagaagacgcgcgacgccctcgacaacctggccgtcctgcacaccgccgaggcgggcgggcgggcctacaaccacgccctctccgagctgcccgagaccctggagaccctcctgctgctcacgctgctggccaccgtgaccggcggcatcttcctcttcctgatgagcgggcgcggcatcgggaagatgaccctgggcatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacctacgtggtgatcgccatcctgaccgtcgtggccgcgaccatggccaacgagatggggttcctggagaagacgaagaaggacctcggcctgggctccatcgccacccagcagccggagagcaacatcctggacatcgacctccgccccgcctccgcctggaccctgtacgcggtggccaccacgttcgtcacccccatgctgcggcacagcatcgagaacagctccgtgaacgtgagcctcaccgccatcgccaaccaggccaccgtcctgatggggctgggcaaggggtggcccctctccaagatggacatcggcgtgccgctgctggcgatcgggtgctacagccaggtgaaccccatcacgctcaccgccgccctgctgctcctggtcgcccactacgcgatcatcggccccggcctgcaggccaaggccacccgcgaggcccagaagcgggccgcggccgggatcatgaagaaccccaccgtggacggcatcacggtgatcgacctcgacccgatcccctacgaccccaagttcgagaagcagctggggcaggtcatgctgctcatcctgtgcgtgacccaggtgctgatgatgcgcaccacctgggccctctgcgaggccctgacgctggccaccggccccatctccaccctctgggaggggaacccgggccggttctggaacaccacgatcgcggtcagcatggccaacatcttccgcggctcctacctggccggggccggcctcctcttcagcatcatgaagaacaccaccaacacccggcgcgggacgggcaacatcggcgagaccctgggggagaagtggaagtcccgcctgaacgccctcggcaagagcgagttccagatctacaagaagtccgggatccaggaggtggaccggaccctggcgaaggagggcatcaagcgcggggagaccgaccaccacgccgtgagccggggctccgccaagctgcgctggttcgtcgagcggaacatggtgacgcccgagggcaaggtggtcgacctcgggtgcggccgcgggggctggagctactactgcgggggcctgaagaacgtgcgggaggtgaagggcctgaccaagggcggccccgggcacgaggagcccatcccgatgtccacctacggctggaacctcgtccgcctgcagagcggggtggacgtgttcttcatcccgcccgagaagtgcgacaccctgctctgcgacatcggcgagtccagccccaacccgacggtcgaggccggccggaccctgcgcgtgctgaacctcgtggagaactggctgaacaacaacacccagttctgcatcaaggtcctgaacccctacatgccctccgtgatcgagaagatggaggcgctgcagcggaagtacgggggcgccctcgtgcgcaacccgctgagccggaacagcacccacgagatgtactgggtctccaacgccagcgggaacatcgtgtccagcgtgaacatgatctcccgcatgctgatcaaccggttcaccatgcgccacaagaaggccacgtacgagcccgacgtcgacctcggcagcgggacccggaacatcggcatcgagtccgagatccccaacctggacatcatcggcaagcgcatcgagaagatcaagcaggagcacgagaccagctggcactacgaccaggaccacccctacaagacctgggcctaccacgggtcctacgagacgaagcagaccggcagcgcgtccagcatggtgaacggggtggtccggctgctcaccaagccgtgggacgtgctgcccaccgtgacgcagatggccatgaccgacaccacccccttcggccagcagcgcgtcttcaaggagaaggtggacacgcgcacccaggagcccaaggagggcaccaagaagctgatgaagatcaccgccgagtggctctggaaggagctggggaagaagaagacgccgcggatgtgcacccgcgaggagttcacccggaaggtgcgctccaacgccgccctgggcgcgatcttcaccgacgagaacaagtggaagtccgcccgggaggccgtcgaggactcccgcttctgggagctcgtggacaaggagcggaacctgcacctggaggggaagtgcgagacgtgcgtgtacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgtccggggtcgagggcgaggggctccacaagctgggctacatcctgcgcgacgtgagcaagaaggagggcggggccatgtacgccgacgacaccgcgggctgggacacccggatcaccctcgaggacctgaagaacgaggagatggtcacgaaccacatggagggggagcacaagaagctggccgaggccatcttcaagctcacctaccagaacaaggtggtgcgcgtccagcggcccacgccccggggcaccgtgatggacatcatcagccggcgcgaccagcgggggtccggccaggtgggcacgtacgggctgaacaccttcaccaacatggaggcccagctgatccgccagatggagggcgagggggtcttcaagaacatccagcacctcaccgccacggaggagatcgcggtgcagaactggctggcccgggtgggccgcgagcgcctgagccggatggccatctccggcgacgactgcgtcgtgaagcccctcgacgaccgcttcgccaacgccctgaccgcgctgaacgacatggggaagatccggaaggacatccagcagtgggagccgagcaagggctggaacgactggacccaggtgcccttctgctcccaccacttccacgagctcatcatgaaggacgggcgcgtcctggtggtgccctgccggaaccaggacgagctgatcggccgcgcccggatcagccagggggccggctggtccctccgcgagaccgcctgcctgggcaagagctacgcccagatgtggtccctgatgtacttccaccggcgcgacctccggctggcggccaacgccatctgcagcgccgtcccctcccactgggtgccgacgagccgcaccacctggtccatccacgccaagcacgagtggatgaccaccgaggacatgctgacggtgtggaaccgggtctggatccgcgagaacccctggatggaggacaagacccccgtggagagctgggaggagatcccctacctcgggaagcgggaggaccagtggtgcggctccctgatcgggctgaccagccgcgcgacctgggccaagaacatccaggccgccatcaaccaggtgcggtccctcatcggcaacgaggagtacacggactacatgccgagcatgaagcgcttccggcgcgaggaggaggaggcgggggtcctgtggtga

SEQ ID NO: 9336 - RNA, 9876 nt, synthetic construct
  misc_feature 1..9876: note = derived and/or modified CDS sequence (opt1) from DENV-2__FJ687445__SS-prME
  source 1..9876: mol_type = other RNA
agcgtgggcatgatcatcatgctgatccccaccgtgatggcgttccacctcaccacccgcaacggggagccccacatgatcgtgagcatccaggagaagggcaagagcctgctgttcaagaccgaggacggggtgaacatgtgcaccctcatggccatggacctgggcgagctgtgcgaggacaccatcacctacaagtgccccctcctgcggcagaacgagcccgaggacatcgactgctggtgcaactccaccagcacctgggtcacctacgggacgtgcaccaccaccggcgagcaccgccgggagaagcgctccgtggcgctggtgccccacgtcggcatggggctcgagacgcggaccgagacctggatgagctccgagggcgcctggaagcacgcccagcgcatcgagacctggatcctgcggcacccggggttcacgatcatggccgccatcctggcgtacaccatcggcaccacccacttccagcgcacgctcatcttcatcctgctgaccgccgtggcccccagcatgaccatgcggtgcatcgggatctccaaccgcgacttcgtggagggcgtcagcggcgggtcctgggtggacatcgtgctcgagcacggcagctgcgtcaccacgatggccaagaacaagcccaccctggacttcgagctgatcaagaccgaggcgaagcagcccgccaccctccggaagtactgcatcgaggccaagctgacgaacaccaccaccgagtcccgctgccccacgcagggggagcccagcctgaaggaggagcaggacaagcggttcgtgtgcaagcactccatggtggaccgcggctggggcaacgggtgcggcctcttcgggaagggcgggatcgtgacctgcgccatgttcacgtgcaagaagaacatggagggcaagatcgtgcagcccgagaacctggagtacaccatcgtggtcacgccccacagcggcgaggagcacgccgtggggaacgacaccggcaagcacgggaaggagatcaaggtgaccccgcagtccagcatcaccgaggcggagctgaccggctacgggacggtcaccatggagtgcagcccccggaccggcctcgacttcaacgagatggtgctgctgcagatggagaacaaggcctggctcgtgcaccgccagtggttcctggacctgcccctcccctggctgccgggcgccgacacccaggggagcaactggatccagaaggagacgctggtcaccttcaagaacccccacgccaagaagcaggacgtggtcgtgctcggcagccaggagggggccatgcacaccgcgctgaccggcgccacggagatccagatgtccagcgggaacctcctgttcaccggccacctgaagtgccggctgcgcatggacaagctccagctgaagggcatgtcctacagcatgtgcaccgggaagttcaaggtggtcaaggagatcgccgagacccagcacggcacgatcgtgatccgggtgcagtacgagggggacggctccccctgcaagatccccttcgagatcatggacctggagaagcgctacgtcctcggccggctgatcaccgtgaacccgatcgtgaccgagaaggacagccccgtcaacatcgaggccgagccgcccttcggggactcctacatcatcatcggcgtggagccggggcagctgaagctcaactggttcaagaagggcagctccatcgggcagatgttcgagaccacgatgcgcggcgccaagcgcatggcgatcctgggcgacaccgcctgggacttcgggagcctgggcggggtgttcacctccatcggcaaggccctccaccaggtcttcggggccatctacggcgccgcgttcagcggcgtgtcctggaccatgaagatcctgatcggggtgatcatcacgtggatcggcatgaacagccggtccaccagcctgtccgtcagcctggtgctcgtgggggtcgtgaccctgtacctgggcgtgatggtccaggccgactccgggtgcgtggtgagctggaagaacaaggagctcaagtgcggcagcggcatcttcatcaccgacaacgtccacacgtggaccgagcagtacaagttccagcccgagtcccccagcaagctggcctccgccatccagaaggcgcaggaggaggggatctgcggcatccgcagcgtgacccggctggagaacctcatgtggaagcagatcacccccgagctgaaccacatcctggccgagaacgaggtgaagctcacgatcatgaccggggacatcaagggcatcatgcaggccgggaagcgctccctgcggccgcagcccaccgagctgaagtacagctggaagacctggggcaaggccaagatgctctccacggagagccacaaccagaccttcctgatcgacggccccgagaccgccgagtgcccgaacaccaaccgcgcgtggaactccctggaggtcgaggactacgggttcggcgtgttcacgaccaacatctggctcaagctgaaggagaagcaggacgccttctgcgacagcaagctgatgtccgccgccatcaaggacaaccgggccgtgcacgcggacatggggtactggatcgagagcgccctcaacgacacctggaagatcgagaaggcctccttcatcgaggtcaagaactgccactggcccaagagccacaccctgtggtccaacggcgtgctggagagcgagatgatcatccccaagaacctcgccggccccgtgtcccagcacaactaccgcccggggtaccacacccagatcgccggcccctggcacctggggaagctggagatggacttcgacttctgcgacggcacgaccgtcgtggtgaccgaggactgcgggaaccggggccccagcctccgcaccacgaccgcgagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgacggccggccacgggcaggtcgacaacttctccctgggcgtcctgggcatggccctcttcctggaggagatgctgcggacccgcgtggggaccaagcacgccatcctcctggtggcggtcagcttcgtgaccctgatcacgggcaacatgtccttcaaggacctcgggcgggtggtcgtgatggtgggcgccaccatgaccgacgacatcgggatgggcgtcacctacctggccctgctcgccgccttcaaggtgcgccccacgttcgcggccggcctgttcctgcggaagctcaccagcaaggagctgatgatgaccaccatcgggatcgtgctgctctcccagagcacgatccccgagaccatcctggagctgaccgacgccctcgccctgggcatgatggtcctgaagatggtgcgcgacatggagaagtaccagctcgccgtcaccatcatggcgatcctgtgcgtgccgaacgccgtgatcctgcagaacgcctggaaggtctcctgcacgatcctcgccgtggtgagcgtcagccccctgctgctcaccagctcccagcagaagaccgactggatccccctggccctgaccatcaaggggctcaaccccacggcgatcttcctgaccaccctgagccgcaccaacaagaagcggtcctggccgctcaacgaggccatcatggccgtgggcatggtgagcatcctggcctccagcctgctcaagaacgacatccccatgacgggccccctggtcgccggcgggctgctcaccgtgtgctacgtgctgaccgggcgctccgccgacctggagctcgagcgggccaccgacgtcaagtgggaggaccaggccgagatcagcgggagctcccccatcctgagcatcacgatctccgaggacgggagcatgtccatcaagaacgaggaggaggagcagaccctgaccatcctcatccgcaccggcctgctggtgatcagcggcctcttcccggtgtccatccccatcaccgccgcggcctggtacctgtgggaggtcaagaagcagcgggccggggtgctgtgggacgtgccctccccgccgcccatgggcaaggccgagctcgaggacggggcctaccgcatcaagcagcggggcatcctggggtactcccagatcggcgcgggcgtctacaaggaggggacgttccacaccatgtggcacgtgacccgcggcgccgtgctgacccacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgagcctggacttctcccccggcacgagcggctcccccatcatcgacaagaaggggaaggtggtcggcctctacgggaacggcgtggtgacccggagcggcgcctacgtctccgccatcgcccagaccgagaagtccatcgaggacaaccccgacatcgaggacgacatcttccgcaagcggcgcctgaccatcatggacctgcaccccggggccggcaagacgaagcggtacctgcccgcgatcgtgcgcgaggccatcaagcgggggctccgcaccctgatcctggccccgacccgggtggtcgccgcggagatggaggaggccctccgcggcctgcccatccggtaccagacccccgccatccgcgccgagcacacggggcgcgagatcgtggacctgatgtgccacgccaccttcaccatgcggctcctgtcccccgtgcgcgtcccgaactacaacctgatcatcatggacgaggcgcacttcaccgaccccgccagcatcgccgcccggggctacatcagcacgcgcgtggagatgggcgaggccgcggggatcttcatgaccgccacgccgcccggctcccgggacccgttcccccagagcaacgcccccatcatcgacgaggagcgcgagatccccgagcggtcctggaacagcgggcacgagtgggtgaccgacttcaagggcaagacggtctggttcgtgccgtccatcaaggccgggaacgacatcgccgcgtgcctccgcaagaacggcaagaaggtgatccagctgagccggaagaccttcgactccgagtacgtcaagacccgcaccaacgactgggacttcgtggtgacgaccgacatcagcgagatgggcgccaacttcaaggccgagcgggtcatcgacccccgccggtgcatgaagcccgtgatcctgaccgacggggaggagcgcgtgatcctcgccggccccatgccggtcacccactccagcgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacgcccgagggcatcatcccgtccatgttcgagcccgagcgggagaaggtggacgccatcgacggcgagtaccgcctgcgcggggaggcgcggaagaccttcgtggacctgatgcgccggggcgacctccccgtctggctggcctacaaggtggccgccgaggggatcaactacgccgaccgccggtggtgcttcgacggcatcaagaacaaccagatcctggaggagaacgtcgaggtggagatctggaccaaggagggggagcgcaagaagctcaagccgcggtggctggacgcgcgcatctacagcgaccccctggccctcaaggagttcaaggagttcgccgccggccggaagtccctgaccctgaacctcatcacggagatgggccgcctgcccaccttcatgacccagaagacccgggacgccctggacaacctcgcggtgctgcacacggccgaggccgggggccgcgcctacaaccacgcgctgagcgagctccccgagaccctggagaccctgctcctgctgaccctcctggccaccgtcaccgggggcatcttcctgttcctcatgtccggccgggggatcggcaagatgaccctggggatgtgctgcatcgtgaccgccagcatcctgctctggtacgcccagatccagccgcactggatcgccgcgtccatcatcctggagttcttcctgatcgtgctcctgatccccgagcccgagaagcagcgcacgccccaggacaaccagctgacgtacgtcgtgatcgccatcctcaccgtggtcgccgccaccatggccaacgagatgggcttcctggagaagaccaagaaggacctggggctcggcagcatcgcgacgcagcagccggagtccaacatcctggacatcgacctgcggcccgccagcgcctggaccctctacgccgtggccaccaccttcgtgacgcccatgctgcgccacagcatcgagaactccagcgtcaacgtgtccctgaccgcgatcgccaaccaggccaccgtgctcatgggcctggggaagggctggcccctgagcaagatggacatcggggccccgctcctggccatcggctgctactcccaggtcaaccccatcaccctgacggcggccctcctgctgctcgtggcccactacgccatcatcgggcccggcctgcaggcgaaggccacccgggaggcccagaagcgcgccgccgcgggcatcatgaagaaccccaccgtggacgggatcaccgtcatcgacctggacccgatcccccacgaccccaagttcgagaagcagctcggccaggtgatgctgctggtgctctgcgtcacccaggtgctgatgatgcggaccacctgggccctgtgcgaggccctcaccctggccacggggcccatcagcaccctgtgggagggcaacccggggcgcttctggaacaccaccatcgccgtgtccatggcgaacatcttccggggcagctacctcgccggcgccgggctgctgttctccatcatgaagaacacgaccaacagccgccgcggcaccgggaacatcggcgagaccctcggcgagaagtggaagtcccggctgaacgccctgggcaagagcgagttccagatctacaagaagtccggcatccaggaggtcgaccgcacgctcgccaaggaggggatcaagcggggcgagaccgaccaccacgcggtgagccgcgggtccgccaagctgcggtggttcgtggagcgcaacatggtcacccccgagggcaaggtggtggacctgggctgcgggcggggcgggtggagctactactgcggcgggctcaagaacgtccgcgaggtgaagggcctgaccaagggcgggcccggccacgaggagcccatcccgatgtccacgtacgggtggaacctggtgcggctccagagcggcgtcgacgtgttcttcatcccgcccgagaagtgcgacaccctgctgtgcgacatcggggagtccagccccaacccgaccgtggaggccggccgcaccctccgggtcctgaacctggtggagaactggctcaacaacaacacccagttctgcatcaaggtgctgaacccctacatgcccagcgtcatcgagaagatggagacgctgcagcgcaagtacggcggggccctggtgcggaacccgctctcccgcaacagcacccacgagatgtactgggtgtccaacgcgagcggcaacatcgtctccagcgtgaacatgatctcccggatgctgatcaaccgcttcaccatgcggcacaagaaggccacctacgagcccgacgtggacctggggagcggcacgcgcaacatcgggatcgagtccgagatccccaacctcgacatcatcggcaagcggatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctgaccaagccgtgggacgtcctccccaccgtgacccagatggccatgacggacaccacccccttcgggcagcagcgcgtgttcaaggagaaggtcgacacccggacgcaggagcccaaggagggcaccaagaagctgatgaagatcaccgcggagtggctgtggaaggagctcggcaagaagaagaccccgcgcatgtgcacgcgggaggagttcacccgcaaggtgcggtccaacgccgccctgggggccatcttcaccgacgagaacaagtggaagtccgcccgcgaggcggtcgaggactcccggttctgggagctggtggacaaggagcgcaacctccacctggagggcaagtgcgagacctgcgtgtacaacatgatggggaagcgggagaagaagctgggcgagttcgggaaggccaagggcagccgcgccatctggtacatgtggctcggcgcccggttcctggagttcgaggccctggggttcctcaacgaggaccactggttctcccgcgagaacagcctgagcggcgtcgagggggagggcctgcaccggctcgggtacatcctgcgcgacgtgtccaagaaggagggcggcgcgatgtacgccgacgacacggccgggtgggacacccggatcaccctggaggacctcaagaacgaggagatggtgaccaaccacatggagggcgagcacaagaagctggccgaggcgatcttcaagctgacgtaccagaacaaggtcgtgcgcgtgcagcggcccacgccccgggggaccgtcatggacatcatcagccggcgcgaccagcggggctccggccaggtggggacctacggcctcaacacgttcaccaacatggaggcccagctgatccgccagatggagggggagggcgtgttcaagaacatccagcacctgaccgtcaccgaggagatcgccgtgcagaactggctcgcccgcgtggggcgggagcgcctgagccggatggccatctccggcgacgactgcgtcgtgaagcccctggacgaccgcttcgcgagcgccctcacggccctgaacgacatgggcaagatccggaaggacatccagcagtgggagccgtcccgcgggtggaacgactggacccaggtgcccttctgcagccaccacttccacgagctgatcatgaaggacggccgggtcctcgtggtgccctgccgcaaccaggacgagctgatcgggcgggcccgcatctcccagggcgccgggtggagcctgcgggagaccgcgtgcctcggcaagtcctacgcccagatgtggagcctgatgtacttccaccgccgggacctgcgcctcgccgccaacgccatctgctccgcggtccccagccactgggtgccgacctcccggaccacgtggagcatccacgccaagcacgagtggatgaccaccgaggacatgctgaccgtgtggaaccgcgtctggatccaggagaacccctggatggaggacaagacgcccgtggagtcctgggaggagatcccctacctgggcaagcgggaggaccagtggtgcgggagcctcatcggcctgaccagccgcgccacctgggccaagaacatccaggtggccatcaaccaggtccggtccctgatcgggaacgaggagtacaccgactacatgccgagcatgaagcgcttccgccgggaggaggaggaggcgggcgtgctctggtga

SEQ ID NO: 9337 - RNA, 9876 nt, synthetic construct
  misc_feature 1..9876: note = derived and/or modified CDS sequence (opt1) from DENV-2__FJ687447__SS-prME
  source 1..9876: mol_type = other RNA
agcgccggcatgatcatcatgctgatccccaccgtgatggccttccacctcaccacccgcaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgagcagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggacctccctcgacttcaacgagatggtcctgctgcagatggagaacaaggcctggctcgtgcaccgccagtggttcctggacctgcccctcccctggctgccgggcgccgacaagcaggagagcaactggatccagaaggagaccctggtgaccttcaagaacccccacgcgaagaagcaggacgtcgtggtcctcgggagccaggagggcgccatgcacacggccctgaccggggccaccgagatccagatgtccagcggcaacctcctgttcaccgggcacctgaagtgccggctgcgcatggacaagctccagctgaagggcatgtcctacagcatgtgcacgggcaagttcaaggtggtgaaggagatcgccgagacccagcacgggaccatcgtcatccgggtgcagtacgagggcgacgggtccccctgcaagatccccttcgagatcatggacctggagaagcgctacgtgctcggccggctgatcaccgtcaacccgatcgtgacggagaaggacagccccgtgaacatcgaggcggagccgcccttcggcgactcctacatcatcatcggggtcgagccgggccagctgaagctcaactggttcaagaaggggagctccatcggccagatgttcgagaccaccatgcgcggggccaagcgcatggccatcctgggcgacaccgcctgggacttcggcagcctcggcggggtgttcacgtccatcgggaaggccctccaccaggtgttcggggcgatctacggggccgccttcagcggcgtctcctggaccatgaagatcctgatcggcgtgatcatcacctggatcgggatgaacagccggtccaccagcctgtccgtgagcctggtcctcgtgggcatcgtgacgctgtacctgggggtcatggtgcaggccgactccggctgcgtggtcagctggaagaacaaggagctcaagtgcgggagcggcatcttcatcaccgacaacgtgcacacctggaccgagcagtacaagttccagcccgagtcccccagcaagctggcgtccgccatccagaaggcccaggaggagggcatctgcgggatccgcagcgtgacgcggctggagaacctcatgtggaagcagatcacccccgagctgaaccacatcctggccgagaacgaggtcaagctcaccatcatgaccggcgacatcaaggggatcatgcaggccggcaagcgctccctgcggccgcagcccacggagctgaagtacagctggaagacctgggggaaggcgaagatgctctccaccgagagctacaaccagaccttcctgatcgacggccccgagacggccgagtgcccgaacaccaaccgcgcctggaactccctggaggtggaggactacggcttcggggtgttcaccaccaacatctggctcaagctgaaggagaagcaggacgccttctgcgacagcaagctgatgtccgccgcgatcaaggacaaccgggccgtccacgccgacatgggctactggatcgagagcgccctcaacgacacgtggaagatcgagaaggcctccttcatcgaggtgaagaactgccactggcccaagagccacaccctgtggtccaacggggtgctggagagcgagatgatcatccccaagaacctcgcgggccccgtctcccagcacaactaccgcccgggctaccacacccagatcgccgggccctggcacctgggcaagctggagatggacttcgacttctgcgacgggaccaccgtgatcgtgacggaggactgcggcaaccgggggcccagcctccgcaccaccaccgccagcggcaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccaggtggacaacttctccctgggggtcctgggcatggccctgttcctggaggagatgctgcggacccgcgtgggcacgaagcacgccatcctcctggtggccgtcagcttcgtgaccctgatcaccgggaacatgtccttcaaggacctcggccgggtggtcgtgatggtgggggccaccatggccgacgacatcggcatgggggtcacgtacctggcgctgctcgccgccttcaaggtgcgccccaccttcgccgccggcctgctgctccggaagctgaccagcaaggagctgatgatgaccacgatcggcatcgtgctcctgtcccagagcaccatccccgagaccatcctggagctcaccgacgcgctggccctggggatgatggtcctcaagatcgtgcgcaacatggagaagtaccagctggccgtgacgatcatggccatcctgtgcgtcccgaacgccgtgatcctccagaacgcgtggaaggtctcctgcaccatcctggccgtggtgagcgtcagccccctgctcctgaccagctcccagcagaagaccgactggatccccctggccctcacgatcaagggcctgaaccccaccgccatcttcctgaccaccctcagccgcacgaacaagaagcggtcctggccgctgaacgaggcgatcatggccgtggggatggtgagcatcctggcctccagcctcctgaagaacgacatccccatgaccggccccctggtcgccggcgggctcctgaccgtgtgctacgtgctgaccggccgctccgccgacctcgagctggagcgggcgacggacgtcaagtgggaggaccaggccgagatcagcgggagctcccccatcctgagcatcaccatctccgaggacggcagcatgtccatcaagaacgaggaggaggagcagaccctcaccatcctgatccgcacggggctgctcgtgatcagcggcctgttcccgatctccatccccatcaccgccgccgcctggtacctgtgggaggtgaagaagcagcgggcgggcgtcctctgggacgtgccctccccgccgcccatcgggaaggccgagctggaggacggcgcctaccgcatcaagcagaaggggatcctgggctactcccagatcggggccggcgtgtacaaggagggcaccttccacaccatgtggcacgtcacccgcggggcggtgctcatgcacaagggcaagcgcatcgagcccagctgggcggacgtgaagaaggacctgatctcctacgggggcgggtggaagctggagggcgagtggaaggagggcgaggaggtccaggtgctcgccctggagcccgggaagaacccccgggccgtgcagacgaagcccggcctgttcaagaccaacaccgggaccatcggcgccgtcagcctcgacttctcccccgggacgagcggctcccccatcatcgacaagaagggcaaggtggtggggctgtacggcaacggggtcgtgacccgcagcggcgcctacgtgtccgcgatcgcccagaccgagaagtccatcgaggacaaccccgagatcgaggacgacatcttccggaagcgccggctgaccatcatggacctgcaccccggcgccgggaagacgaagcgctacctccccgccatcgtccgggaggcgatcaagcgcggcctgcggaccctgatcctcgccccgacccgcgtggtggccgccgagatggaggaggccctgcgggggctgcccatccgctaccagacccccgcgatccgggccgagcacacgggccgcgagatcgtcgacctcatgtgccacgccaccttcaccatgcgcctgctgtcccccgtgcgggtgccgaactacaacctcatcatcatggacgaggcccacttcaccgaccccgccagcatcgcggcccgcgggtacatcagcacgcgggtcgagatgggcgaggccgccggcatcttcatgaccgccacgccgcccgggtcccgcgacccgttcccccagagcaacgcgcccatcatcgacgaggagcgggagatccccgagcgctcctggaacagcggccacgagtgggtgaccgacttcaaggggaagacggtgtggttcgtcccgtccatcaaggccggcaacgacatcgccgcctgcctgcggaagaacgggaagaaggtgatccagctgagccgcaagaccttcgactccgagtacgtgaagacccggaccaacgactgggacttcgtcgtgacgaccgacatcagcgagatgggcgcgaacttcaaggccgagcgcgtgatcgacccccggcgctgcatgaagcccgtcatcctcaccgacggcgaggagcgggtgatcctggccgggcccatgccggtgacccactccagcgccgcccagcgccggggccgcatcgggcggaaccccaagaacgagaacgaccagtacatctacatgggcgagcccctggagaacgacgaggactgcgcgcactggaaggaggccaagatgctcctggacaacatcaacacgcccgaggggatcatcccgtccatgttcgagcccgagcgcgagaaggtcgacgccatcgacggcgagtaccggctgcgcggcgaggcccgcaagaccttcgtggacctcatgcggcgcggggacctgcccgtgtggctggccttcaaggtcgcggccgagggcatcaactacgccgaccggcgctggtgcttcgacgggatcaagaacaaccagatcctcgaggagaacgtggaggtggagatctggaccaaggagggcgagcggaagaagctgaagccgcgctggctggacgcccggatctacagcgaccccctcgccctgaaggagttcaaggagttcgcggccgggcgcaagtccctgaccctcaacctgatcacggagatgggccggctgcccaccttcatgacccagaagacccgcgacgccctcgacaacctggccgtcctgcacacggcggaggccggcgggcgggcctacaaccacgccctcagcgagctgcccgagaccctggagaccctcctgctgctcaccctgctggccacggtgaccggcgggatcttcctcttcctgatgtccggccgcggcatcgggaagatgaccctgggcatgtgctgcatcatcaccgcgagcatcctcctgtggtacgcccagatccagccgcactggatcgccgcctccatcatcctggagttcttcctcatcgtcctgctgatccccgagcccgagaagcagcggacgccccaggacaaccagctcacgtacgtggtgatcgccatcctgaccgtcgtggcggccaccatggccaacgagatggggttcctggagaagaccaagaaggacctcggcctggggagcatcgccacgcagcagccggagtccaacatcctggacatcgacctccgccccgccagcgcgtggaccctgtacgccgtggccaccaccttcgtcacgcccatgctgcggcacagcatcgagaactccagcgtgaacgtgtccctcaccgccatcgccaaccaggcgaccgtcctgatgggcctgggcaaggggtggcccctcagcaagatggacatcggcgtgccgctgctggccatcgggtgctactcccaggtgaaccccatcaccctcacggccgccctgctgctcctggtcgcgcactacgccatcatcggccccgggctgcaggccaaggccacccgcgaggcccagaagcgggcggccgccggcatcatgaagaaccccaccgtggacggcatcaccgtgatcgacctcgacccgatcccctacgaccccaagttcgagaagcagctggggcaggtcatgctgctcatcctgtgcgtgacccaggtgctgatgatgcgcaccacctgggccctctgcgaggccctgaccctggcgacgggccccatcagcaccctctgggaggggaacccgggccggttctggaacaccaccatcgccgtctccatggccaacatcttccgcgggagctacctggccggcgccggcctcctcttctccatcatgaagaacacgaccaacacccggcgcgggaccggcaacatcggggagacgctgggcgagaagtggaagtcccgcctgaacgcgctcggcaagtccgagttccagatctacaagaagtccgggatccaggaggtggaccggaccctggccaaggagggcatcaagcgcggggagaccgaccaccacgccgtgtcccggggcagcgccaagctgcgctggttcgtcgagcggaacatggtgacccccgaggggaaggtggtcgacctcggctgcggccgcgggggctggtcctactactgcgggggcctgaagaacgtgcgggaggtgaaggggctgacgaagggcggccccgggcacgaggagcccatcccgatgagcacctacggctggaacctcgtccgcctgcagtccggggtggacgtgttcttcatcccgcccgagaagtgcgacaccctgctctgcgacatcggcgagagctcccccaacccgaccgtcgaggcggggcggacgctgcgcgtgctgaacctcgtggagaactggctgaacaacaacacccagttctgcatcaaggtcctgaacccctacatgcccagcgtgatcgagaagatggaggccctgcagcggaagtacggcggcgccctcgtgcgcaacccgctgagccggaactccacccacgagatgtactgggtcagcaacgcctccgggaacatcgtgagctccgtgaacatgatcagccgcatgctgatcaaccggttcaccatgcgccacaagaaggccacctacgagcccgacgtcgacctcggctccgggacgcggaacatcggcatcgagagcgagatccccaacctggacatcatcgggaagcgcatcgagaagatcaagcaggagcacgagacctcctggcactacgaccaggaccacccctacaagacctgggcgtaccacggcagctacgagaccaagcagacgggctccgccagctccatggtgaacggggtggtccggctgctcaccaagccgtgggacgtgctgcccaccgtgacccagatggccatgacggacaccacccccttcggccagcagcgcgtcttcaaggagaaggtggacacccgcacgcaggagcccaaggaggggaccaagaagctgatgaagatcaccgccgagtggctctggaaggagctgggcaagaagaagaccccgcggatgtgcacgcgcgaggagttcacccggaaggtgcgcagcaacgccgcgctgggcgccatcttcaccgacgagaacaagtggaagtccgcccgggaggccgtcgaggacagccgcttctgggagctcgtggacaaggagcggaacctgcacctggaggggaagtgcgagacctgcgtgtacaacatgatgggcaagcgcgagaagaagctcggggagttcggcaaggccaaggggtcccgggcgatctggtacatgtggctgggcgcccgcttcctggagttcgaggccctcggcttcctgaacgaggaccactggttcagccgggagaactccctgagcggggtcgagggcgaggggctccacaagctgggctacatcctgcgcgacgtgagcaagaaggagggcggcgccatgtacgcggacgacacggccggctgggacacccggatcaccctcgaggacctgaagaacgaggagatggtcaccaaccacatggagggggagcacaagaagctggccgaggccatcttcaagctcacgtaccagaacaaggtggtgcgcgtccagcggcccacgccccggggcaccgtgatggacatcatctcccggcgcgaccagcgggggagcggccaggtggggacctacggcctgaacacgttcaccaacatggaggcccagctgatccgccagatggagggcgagggggtcttcaagaacatccagcacctcaccgtgaccgaggaggtggcggtccagaactggctggcccgggtgggccgcgagcgcctgtcccggatggccatcagcggggacgactgcgtggtcaagcccctcgacgaccgcttcgccaacgccctgacggcgctgaacgacatgggcaagatccggaaggacatccagcagtgggagccgtccaagggctggaacgactggacccaggtgcccttctgcagccaccacttccacgagctcatcatgaaggacgggcgcgtgctggtcgtgccctgccggaaccaggacgagctgatcggccgcgcccggatctcccagggggccggctggagcctccgcgagaccgcctgcctggggaagtcctacgcccagatgtggagcctgatgtacttccaccggcgcgacctccggctggcggccaacgccatctgctccgccgtgcccagccactgggtcccgacctcccgcacgacctggagcatccacgccaagcacgagtggatgaccaccgaggacatgctgaccgtgtggaaccgggtgtggatccgcgagaacccctggatggaggacaagacgcccgtcgagtcctgggaggagatcccctacctcggcaagcgggaggaccagtggtgcggcagcctgatcgggctgacctcccgcgcgacctgggccaagaacatccaggccgccatcaaccaggtgcggagcctcatcggcaacgaggagtacaccgactacatgccgagcatgaagcgcttccggcgcgaggaggaggaggcgggggtgctgtggtga

SEQ ID NO: 9338 - RNA, 9876 nt, synthetic construct
  misc_feature 1..9876: note = derived and/or modified CDS sequence (opt1) from DENV-2__FJ810411__SS-prME
  source 1..9876: mol_type = other RNA
agcgccggcatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgagcagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggacctccctcgacttcaacgagatggtcctgctgcagatggagaacaaggcctggctcgtgcaccgccagtggttcctggacctgcccctcccctggctgccgggcgccgacaagcaggagagcaactggatccagaaggagaccctggtgaccttcaagaacccccacgcgaagaagcaggacgtcgtggtcctcgggagccaggagggcgccatgcacacggccctgaccggggccaccgagatccagatgtccagcggcaacctcctgttcaccgggcacctgaagtgccggctgcgcatggacaagctccagctgaagggcatgtcctacagcatgtgcacgggcaagttcaaggtggtgaaggagatcgccgagacccagcacgggaccatcgtcatccgggtgcagtacgagggcgacgggtccccctgcaagatccccttcgagatcatggacctggagaagcgctacgtgctcggccggctgatcaccgtcaacccgatcgtgacggagaaggacagccccgtgaacatcgaggcggagccgcccttcggcgactcctacatcatcatcggggtcgagccgggccagctgaagctcaactggttcaagaaggggagctccatcggccagatgttcgagaccaccatgcgcggggccaagcgcatggccatcctgggcgacaccgcctgggacttcggcagcctcggcggggtgttcacgtccatcgggaaggccctccaccaggtgttcggggcgatctacggggccgccttcagcggcgtctcctggaccatgaagatcctgatcggcgtgatcatcacctggatcgggatgaacagccggtccaccagcctgtccgtgagcctggtcctcgtgggcatcgtgacgctgtacctgggggtcatggtgcaggccgactccggctgcgtggtcagctggaagaacaaggagctcaagtgcgggagcggcatcttcatcaccgacaacgtgcacacctggaccgagcagtacaagttccagcccgagtcccccagcaagctggcgtccgccatccagaaggcccaggaggagggcatctgcgggatccgcagcgtgacgcggctggagaacctcatgtggaagcagatcacccccgagctgaaccacatcctggccgagaacgaggtcaagctcaccatcatgaccggcgacatcaaggggatcatgcaggccggcaagcgctccctgcggccgcagcccacggagctgaagtacagctggaagacctgggggaaggcgaagatgctctccaccgagagctacaaccagaccttcctgatcgacggccccgagacggccgagtgcccgaacaccaaccgcgcctggaactccctggaggtggaggactacggcttcggggtgttcaccaccaacatctggctcaagctgaaggagaagcaggacgccttctgcgacagcaagctgatgtccgccgcgatcaaggacaaccgggccgtccacgccgacatgggctactggatcgagagcgccctcaacgacacgtggaagatcgagaaggcctccttcatcgaggtgaagaactgccactggcccaagagccacaccctgtggtccaacggggtgctggagagcgagatgatcatccccaagaacctcgcgggccccgtctcccagcacaactaccgcccgggctaccacacccagatcgccgggccctggcacctgggcaagctggagatggacttcgacttctgcgacgggaccaccgtgatcgtgacggaggactgcggcaaccgggggcccagcctccgcaccaccaccgccagcggcaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccaggtggacaacttctccctgggggtcctgggcatggccctgttcctggaggagatgctgcggacccgcgtgggcacgaagcacgccatcctcctggtggccgtcagcttcgtgaccctgatcaccgggaacatgtccttcaaggacctcggccgggtggtcgtgatggtgggggccaccatggccgacgacatcggcatgggggtcacgtacctggcgctgctcgccgccttcaaggtgcgccccaccttcgccgccggcctgctgctccggaagctgaccagcaaggagctgatgatgaccacgatcggcatcgtgctcctgtcccagagcaccatccccgagaccatcctggagctcaccgacgcgctggccctggggatgatggtcctcaagatcgtgcgcaacatggagaagtaccagctggccgtgacgatcatggccatcctgtgcgtcccgaacgccgtgatcctccagaacgcgtggaaggtctcctgcaccatcctggccgtggtgagcgtcagccccctgctcctgaccagctcccagcagaagaccgactggatccccctggccctcacgatcaagggcctgaaccccaccgccatcttcctgaccaccctcagccgcacgaacaagaagcggtcctggccgctgaacgaggcgatcatggccgtggggatggtgagcatcctggcctccagcctcctgaagaacgacatccccatgaccggccccctggtcgccggcgggctcctgaccgtgtgctacgtgctgaccggccgctccgccgacctcgagctggagcgggcgacggacgtcaagtgggaggaccaggccgagatcagcgggagctcccccatcctgagcatcaccatctccgaggacggcagcatgtccatcaagaacgaggaggaggagcagaccctcaccatcctgatccgcacggggctgctcgtgatcagcggcctgttcccgatctccatccccatcaccgccgccgcctggtacctgtgggaggtgaagaagcagcgggcgggcgtcctctgggacgtgccctccccgccgcccatcgggaaggccgagctggaggacggcgcctaccgcatcaagcagaaggggatcctgggctactcccagatcggggccggcgtgtacaaggagggcaccttccacaccatgtggcacgtcacccgcggggcggtgctcatgcacaagggcaagcgcatcgagcccagctgggcggacgtgaagaaggacctgatctcctacgggggcgggtggaagctggagggcgagtggaaggagggcgaggaggtccaggtgctcgccctggagcccgggaagaacccccgggccgtgcagacgaagcccggcctgttcaagaccaacaccgggaccatcggcgccgtcagcctcgacttctcccccgggacgagcggctcccccatcatcgacaagaagggcaaggtggtggggctgtacggcaacggggtcgtgacccgcagcggcgcctacgtgtccgcgatcgcccagaccgagaagtccatcgaggacaaccccgagatcgaggacgacatcttccggaagcgccggctgaccatcatggacctgcaccccggcgccgggaagacgaagcgctacctccccgccatcgtccgggaggcgatcaagcgcggcctgcggaccctgatcctcgccccgacccgcgtggtggccgccgagatggaggaggccctgcgggggctgcccatccgctaccagacccccgcgatccgggccgagcacacgggccgcgagatcgtcgacctcatgtgccacgccaccttcaccatgcgcctgctgtcccccgtgcgggtgccgaactacaacctcatcatcatggacgaggcccacttcaccgaccccgccagcatcgcggcccgcgggtacatcagcacgcgggtcgagatgggcgaggccgccggcatcttcatgaccgccacgccgcccgggtcccgcgacccgttcccccagagcaacgcgcccatcatcgacgaggagcgggagatccccgagcgctcctggaacagcggccacgagtgggtgaccgacttcaaggggaagacggtgtggttcgtcccgtccatcaaggccggcaacgacatcgccgcctgcctgcggaagaacgggaagaaggtgatccagctgagccgcaagaccttcgactccgagtacgtgaagacccggaccaacgactgggacttcgtcgtgacgaccgacatcagcgagatgggcgcgaacttcaaggccgagcgcgtgatcgacccccggcgctgcatgaagcccgtcatcctcaccgacggcgaggagcgggtgatcctggccgggcccatgccggtgacccactccagcgccgcccagcgccggggccgcatcgggcggaaccccaagaacgagaacgaccagtacatctacatgggcgagcccctggagaacgacgaggactgcgcgcactggaaggaggccaagatgctcctggacaacatcaacacgcccgaggggatcatcccgtccatgttcgagcccgagcgcgagaaggtcgacgccatcgacggcgagtaccggctgcgcggcgaggcccgcaagaccttcgtggacctcatgcggcgcggggacctgcccgtgtggctggccttcaaggtcgcggccgagggcatcaactacgccgaccggcgctggtgcttcgacgggatcaagaacaaccagatcctcgaggagaacgtggaggtggagatctggaccaaggagggcgagcggaagaagctgaagccgcgctggctggacgcccggatctacagcgaccccctcgccctgaaggagttcaaggagttcgcggccgggcgcaagtccctgaccctcaacctgatcacggagatgggccggctgcccaccttcatgacccagaagacccgcgacgccctcgacaacctggccgtcctgcacacggcggaggccggcgggcgggcctacaaccacgccctcagcgagctgcccgagaccctggagaccctcctgctgctcaccctgctggccacggtgaccggcgggatcttcctcttcctgatgtccggccgcggcatcgggaagatgaccctgggcatgtgctgcatcatcaccgcgagcatcctcctgtggtacgcccagatccagccgcactggatcgccgcctccatcatcctggagttcttcctcatcgtcctgctgatccccgagcccgagaagcagcggacgccccaggacaaccagctcacgtacgtggtgatcgccatcctgaccgtcgtggcggccaccatggccaacgagatggggttcctggagaagaccaagaaggacctcggcctggggagcatcgccacgcagcagccggagtccaacatcctggacatcgacctccgccccgccagcgcgtggaccctgtacgccgtggccaccaccttcgtcacgcccatgctgcggcacagcatcgagaactccagcgtgaacgtgtccctcaccgccatcgccaaccaggcgaccgtcctgatgggcctgggcaaggggtggcccctcagcaagatggacatcggcgtgccgctgctggccatcgggtgctactcccaggtgaaccccatcaccctcacggccgccctgctgctcctggtcgcgcactacgccatcatcggccccgggctgcaggccaaggccacccgcgaggcccagaagcgggcggccgccggcatcatgaagaaccccaccgtggacggcatcaccgtgatcgacctcgacccgatcccctacgaccccaagttcgagaagcagctggggcaggtcatgctgctcatcctgtgcgtgacccaggtgctgatgatgcgcaccacctgggccctctgcgaggccctgaccctggcgacgggccccatcagcaccctctgggaggggaacccgggccggttctggaacaccaccatcgccgtctccatggccaacatcttccgcgggagctacctggccggcgccggcctcctcttctccatcatgaagaacacgaccaacacccggcgcgggaccggcaacatcggggagacgctgggcgagaagtggaagtcccgcctgaacgcgctcggcaagtccgagttccagatctacaagaagtccgggatccaggaggtggaccggaccctggccaaggagggcatcaagcgcggggagaccgaccaccacgccgtgtcccggggcagcgccaagctgcgctggttcgtcgagcggaacatggtgacccccgaggggaaggtggtcgacctcggctgcggccgcgggggctggtcctactactgcgggggcctgaagaacgtgcgggaggtgaaggggctgacgaagggcggccccgggcacgaggagcccatcccgatgagcacctacggctggaacctcgtccgcctgcagtccggggtggacgtgttcttcatcccgcccgagaagtgcgacaccctgctctgcgacatcggcgagagctcccccaacccgaccgtcgaggcggggcggacgctgcgcgtgctgaacctcgtggagaactggctgaacaacaacacccagttctgcatcaaggtcctgaacccctacatgcccagcgtgatcgagaagatggaggccctgcagcggaagtacggcggcgccctcgtgcgcaacccgctgagccggaactccacccacgagatgtactgggtcagcaacgcctccgggaacatcgtgagctccgtgaacatgatcagccgcatgctgatcaaccggttcaccatgcgccacaagaaggccacctacgagcccgacgtcgacctcggctccgggacgcggaacatcggcatcgagagcgagatccccaacctggacatcatcgggaagcgcatcgagaagatcaagcaggagcacgagacctcctggcactacgaccaggaccacccctacaagacctgggcgtaccacggcagctacgagaccaagcagacgggctccgccagctccatggtgaacggggtggtccggctgctcaccaagccgtgggacgtgctgcccaccgtgacccagatggccatgacggacaccacccccttcggccagcagcgcgtcttcaaggagaaggtggacacccgcacgcaggagcccaaggaggggaccaagaagctgatgaagatcaccgccgagtggctctggaaggagctgggcaagaagaagaccccgcggatgtgcacgcgcgaggagttcaccaagaaggtgcggagcaacgccgcgctgggcgccatcttcaccgacgagaacaagtggaagtccgcccgcgaggccgtcgaggacagccggttctgggagctcgtggacaaggagcgcaacctgcacctggaggggaagtgcgagacctgcgtgtacaacatgatgggcaagcgggagaagaagctcggggagttcggcaaggccaaggggtcccgcgcgatctggtacatgtggctgggcgcccggttcctggagttcgaggccctcggcttcctgaacgaggaccactggttcagccgcgagaactccctgagcggggtcgagggcgaggggctccacaagctgggctacatcctgcgggacgtgagcaagaaggagggcggcgccatgtacgcggacgacacggccggctgggacacccgcatcaccctcgaggacctgaagaacgaggagatggtcaccaaccacatggagggggagcacaagaagctggccgaggccatcttcaagctcacgtaccagaacaaggtggtgcgggtccagcgccccacgccccggggcaccgtgatggacatcatctcccgccgggaccagcgcgggagcggccaggtggggacctacggcctgaacacgttcaccaacatggaggcccagctgatccggcagatggagggcgagggggtcttcaagaacatccagcacctcaccgtgaccgaggaggtggcggtccagaactggctggcccgcgtgggccgggagcgcctgtcccgcatggccatcagcggggacgactgcgtggtcaagcccctcgacgaccggttcgccaacgccctgacggcgctgaacgacatgggcaagatccgcaaggacatccagcagtgggagccgtccaagggctggaacgactggacccaggtgcccttctgcagccaccacttccacgagctcatcatgaaggacgggcgggtgctggtcgtgccctgccgcaaccaggacgagctgatcggccgggcccgcatctcccagggggccggctggagcctccgggagaccgcctgcctggggaagtcctacgcccagatgtggagcctgatgtacttccaccgccgggacctccgcctggcggccaacgccatctgctccgccgtgcccagccactgggtcccgacctcccggacgacctggagcatccacgccaagcacgagtggatgaccaccgaggacatgctgaccgtgtggaaccgcgtgtggatccgggagaacccctggatggaggacaagacgcccgtcgagtcctgggaggagatcccctacctcggcaagcgcgaggaccagtggtgcggcagcctgatcgggctgacctcccgggcgacctgggccaagaacatccaggccgccatcaaccaggtgcgcagcctcatcggcaacgaggagtacaccgactacatgccgagcatgaagcggttccgccgggaggaggaggaggcgggggtgctgtggtga

SEQ ID NO: 9339 - RNA, 9876 nt, synthetic construct
  misc_feature 1..9876: note = derived and/or modified CDS sequence (opt1) from DENV-2__FJ744713__SS-prME
  source 1..9876: mol_type = other RNA
agcgccggcatgatcatcatgctgatccccaccgtgatggccttccacctcaccacccggaacggggagccccacatgatcgtcggcatccaggagaagggcaagagcctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacgcggaccgagacctggatgagcagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggacctccctcgacttcaacgagatggtcctgctgcagatggagaacaaggcctggctcgtgcaccgccagtggttcctggacctgcccctcccctggctgccgggcgccgacaagcaggagagcaactggatccagaaggagaccctggtgaccttcaagaacccccacgcgaagaagcaggacgtcgtggtcctcgggagccaggagggcgccatgcacacggccctgaccggggccaccgagatccagatgtccagcggcaacctcctgttcaccgggcacctgaagtgccggctgcgcatggacaagctccagctgaagggcatgtcctacagcatgtgcacgggcaagttcaaggtggtgaaggagatcgccgagacccagcacgggaccatcgtcatccgggtgcagtacgagggcgacgggtccccctgcaagatccccttcgagatcatggacctggagaagcgctacgtgctcggccggctgatcaccgtcaacccgatcgtgacggagaaggacagccccgtgaacatcgaggcggagccgcccttcggcgactcctacatcatcatcggggtcgagccgggccagctgaagctcaactggttcaagaaggggagctccatcggccagatgttcgagaccaccatgcgcggggccaagcgcatggccatcctgggcgacaccgcctgggacttcggcagcctcggcggggtgttcacgtccatcgggaaggccctccaccaggtgttcggggcgatctacggggccgccttcagcggcgtctcctggaccatgaagatcctgatcggcgtgatcatcacctggatcgggatgaacagccggtccaccagcctgtccgtgagcctggtcctcgtgggcatcgtgacgctgtacctgggggtcatggtgcaggccgactccggctgcgtggtcagctggaagaacaaggagctcaagtgcgggagcggcatcttcatcaccgacaacgtgcacacctggaccgagcagtacaagttccagcccgagtcccccagcaagctggcgtccgccatccagaaggcccaggaggagggcatctgcgggatccgcagcgtgacgcggctggagaacctcatgtggaagcagatcacccccgagctgaaccacatcctggccgagaacgaggtcaagctcaccatcatgaccggcgacatcaaggggatcatgcaggccggcaagcgctccctgcggccgcagcccacggagctgaagtacagctggaagacctgggggaaggcgaagatgctctccaccgagagctacaaccagaccttcctgatcgacggccccgagacggccgagtgcccgaacaccaaccgcgcctggaactccctggaggtggaggactacggcttcggggtgttcaccaccaacatctggctcaagctgaaggagaagcaggacgccttctgcgacagcaagctgatgtccgccgcgatcaaggacaaccgggccgtccacgccgacatgggctactggatcgagagcgccctcaacgacacgtggaagatcgagaaggcctccttcatcgaggtgaagaactgccactggcccaagagccacaccctgtggtccaacggggtgctggagagcgagatgatcatccccaagaacctcgcgggccccgtctcccagcacaactaccgcccgggctaccacacccagatcgccgggccctggcacctgggcaagctggagatggacttcgacttctgcgacgggaccaccgtgatcgtgacggaggactgcggcaaccgggggcccagcctccgcaccaccaccgccagcggcaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccaggtggacaacttctccctgggggtcctgggcatggccctgttcctggaggagatgctgcggacccgcgtgggcacgaagcacgccatcctcctggtggccgtcagcttcgtgaccctgatcaccgggaacatgtccttcaaggacctcggccgggtggtcgtgatggtgggggccaccatggccgacgacatcggcatgggggtcacgtacctggcgctgctcgccgccttcaaggtgcgccccaccttcgccgccggcctgctgctccggaagctgaccagcaaggagctgatgatgaccacgatcggcatcgtgctcctgtcccagagcaccatccccgagaccatcctggagctcaccgacgcgctggccctggggatgatggtcctcaagatcgtgcgcaacatggagaagtaccagctggccgtgacgatcatggccatcctgtgcgtcccgaacgccgtgatcctccagaacgcgtggaaggtctcctgcaccatcctggccgtggtgagcgtcagccccctgctcctgaccagctcccagcagaagaccgactggatccccctggccctcacgatcaagggcctgaaccccaccgccatcttcctgaccaccctcagccgcacgaacaagaagcggtcctggccgctgaacgaggcgatcatggccgtggggatggtgagcatcctggcctccagcctcctgaagaacgacatccccatgaccggccccctggtcgccggcgggctcctgaccgtgtgctacgtgctgaccggccgctccgccgacctcgagctggagcgggcgacggacgtcaagtgggaggaccaggccgagatcagcgggagctcccccatcctgagcatcaccatctccgaggacggcagcatgtccatcaagaacgaggaggaggagcagatcctcaccatcctgatccgcaccgggctgctcgtgatcagcggcctgttcccgatctccatccccatcacggccgccgcctggtacctgtgggaggtgaagaagcagcgggcgggcgtcctctgggacgtgccctccccgccgcccatcgggaaggccgagctggaggacggcgcctaccgcatcaagcagaaggggatcctgggctactcccagatcggggccggcgtgtacaaggagggcaccttccacaccatgtggcacgtcacccgcggggcggtgctcatgcacaagggcaagcgcatcgagcccagctgggcggacgtgaagaaggacctgatctcctacgggggcgggtggaagctggagggcgagtggaaggagggcgaggaggtccaggtgctcgccctggagcccgggaagaacccccgggccgtgcagaccaagcccggcctgttcaagacgaacaccgggaccatcggcgccgtcagcctcgacttctcccccgggaccagcggctcccccatcatcgacaagaagggcaaggtggtggggctgtacggcaacggggtcgtgacgcgcagcggcgcctacgtgtccgcgatcgcccagaccgagaagtccatcgaggacaaccccgagatcgaggacgacatcttccggaagcgccggctgaccatcatggacctgcaccccggcgccgggaagaccaagcgctacctccccgccatcgtccgggaggcgatcaagcgcggcctgcggacgctgatcctcgccccgacccgcgtggtggccgccgagatggaggaggccctgcgggggctgcccatccgctaccagacccccgcgatccgggccgagcacaccggccgcgagatcgtcgacctcatgtgccacgccacgttcaccatgcgcctgctgtcccccgtgcgggtgccgaactacaacctcatcatcatggacgaggcccacttcaccgaccccgccagcatcgcggcccgcgggtacatcagcacccgggtcgagatgggcgaggccgccggcatcttcatgacggccacgccgcccgggtcccgcgacccgttcccccagagcaacgcgcccatcatcgacgaggagcgggagatccccgagcgctcctggaacagcggccacgagtgggtgaccgacttcaaggggaagaccgtgtggttcgtcccgtccatcaaggccggcaacgacatcgccgcctgcctgcggaagaacgggaagaaggtgatccagctgagccgcaagacgttcgactccgagtacgtgaagacccggaccaacgactgggacttcgtcgtgaccacggacatcagcgagatgggcgcgaacttcaaggccgagcgcgtgatcgacccccggcgctgcatgaagcccgtcatcctcaccgacggcgaggagcgggtgatcctggccgggcccatgccggtgacccactccagcgccgcccagcgccggggccgcatcgggcggaaccccaagaacgagaacgaccagtacatctacatgggcgagcccctggagaacgacgaggactgcgcgcactggaaggaggccaagatgctcctggacaacatcaacacccccgaggggatcatcccgtccatgttcgagcccgagcgcgagaaggtcgacgccatcgacggcgagtaccggctgcgcggcgaggcccgcaagacgttcgtggacctcatgcggcgcggggacctgcccgtgtggctggccttcaaggtcgcggccgagggcatcaactacgccgaccggcgctggtgcttcgacgggatcaagaacaaccagatcctcgaggagaacgtggaggtggagatctggaccaaggagggcgagcggaagaagctgaagccgcgctggctggacgcccggatctacagcgaccccctcgccctgaaggagttcaaggagttcgcggccgggcgcaagtccctgaccctcaacctgatcaccgagatgggccggctgcccacgttcatgacccagaagacccgcgacgccctcgacaacctggccgtcctgcacaccgcggaggccggcgggcgggcctacaaccacgccctcagcgagctgcccgagacgctggagaccctcctgctgctcaccctgctggccaccgtgacgggcgggatcttcctcttcctgatgtccggccgcggcatcgggaagatgaccctgggcatgtgctgcatcatcaccgcgagcatcctcctgtggtacgcccagatccagccgcactggatcgccgcctccatcatcctggagttcttcctcatcgtcctgctgatccccgagcccgagaagcagcggacgccccaggacaaccagctcacctacgtggtgatcgccatcctgacggtcgtggcggccaccatggccaacgagatggggttcctggagaagaccaagaaggacctcggcctggggagcatcgccacccagcagccggagtccaacatcctggacatcgacctccgccccgccagcgcgtggacgctgtacgccgtggccaccaccttcgtcacccccatgctgcggcacagcatcgagaactccagcgtgaacgtgtccctcacggccatcgccaaccaggcgaccgtcctgatgggcctgggcaaggggtggcccctcagcaagatggacatcggcgtgccgctgctggccatcgggtgctactcccaggtgaaccccatcaccctcaccgccgccctgctgctcctggtcgcgcactacgccatcatcggccccgggctgcaggccaaggccacgcgcgaggcccagaagcgggcggccgccggcatcatgaagaaccccaccgtggacggcatcaccgtgatcgacctcgacccgatcccctacgaccccaagttcgagaagcagctggggcaggtcatgctgctcatcctgtgcgtgacccaggtgctgatgatgcgcacgacctgggccctctgcgaggccctgaccctggcgaccggccccatcagcacgctctgggaggggaacccgggccggttctggaacaccaccatcgccgtctccatggccaacatcttccgcgggagctacctggccggcgccggcctcctcttctccatcatgaagaacaccacgaacacccggcgcgggaccggcaacatcggggagaccctgggcgagaagtggaagtcccgcctgaacgcgctcggcaagtccgagttccagatctacaagaagtccgggatccaggaggtggaccggacgctggccaaggagggcatcaagcgcggggagaccgaccaccacgccgtgtcccggggcagcgccaagctgcgctggttcgtcgagcggaacatggtgacccccgaggggaaggtggtcgacctcggctgcggccgcgggggctggtcctactactgcgggggcctgaagaacgtgcgggaggtgaaggggctgaccaagggcggccccgggcacgaggagcccatcccgatgagcacgtacggctggaacctcgtccgcctgcagtccggggtggacgtgttcttcatcccgcccgagaagtgcgacaccctgctctgcgacatcggcgagagctcccccaacccgaccgtcgaggcggggcggaccctgcgcgtgctgaacctcgtggagaactggctgaacaacaacacgcagttctgcatcaaggtcctgaacccctacatgcccagcgtgatcgagaagatggaggccctgcagcggaagtacggcggcgccctcgtgcgcaacccgctgagccggaactccacccacgagatgtactgggtcagcaacgcctccgggaacatcgtgagctccgtgaacatgatcagccgcatgctgatcaaccggttcaccatgcgccacaagaaggccacctacgagcccgacgtcgacctcggctccgggacccggaacatcggcatcgagagcgagatccccaacctggacatcatcgggaagcgcatcgagaagatcaagcaggagcacgagacgtcctggcactacgaccaggaccacccctacaagacctgggcgtaccacggcagctacgagaccaagcagaccggctccgccagctccatggtgaacggggtggtccggctgctcacgaagccgtgggacgtgctgcccaccgtgacccagatggccatgaccgacacgacccccttcggccagcagcgcgtcttcaaggagaaggtggacacccgcacccaggagcccaaggaggggacgaagaagctgatgaagatcaccgccgagtggctctggaaggagctgggcaagaagaagaccccgcggatgtgcacccgcgaggagttcacgcggaaggtgcgcagcaacgccgcgctgggcgccatcttcaccgacgagaacaagtggaagtccgcccgggaggccgtcgaggacagccgcttctgggagctcgtggacaaggagcggaacctgcacctggaggggaagtgcgagacctgcgtgtacaacatgatgggcaagcgcgagaagaagctcggggagttcggcaaggccaaggggtcccgggcgatctggtacatgtggctgggcgcccgcttcctggagttcgaggccctcggcttcctgaacgaggaccactggttcagccgggagaactccctgagcggggtcgagggcgaggggctccacaagctgggctacatcctgcgcgacgtgagcaagaaggagggcggcgccatgtacgcggacgacaccgccggctgggacacgcggatcaccctcgaggacctgaagaacgaggagatggtcaccaaccacatggagggggagcacaagaagctggccgaggccatcttcaagctcacctaccagaacaaggtggtgcgcgtccagcggcccacgccccgcggcaccgtgatggacatcatctcccggcgcgaccagcgggggagcggccaggtggggacctacggcctgaacaccttcacgaacatggaggcccagctgatccgccagatggagggcgagggggtcttcaagaacatccagcacctcaccgtgaccgaggaggtggcggtccagaactggctggcccgggtgggccgcgagcgcctgtcccggatggccatcagcggggacgactgcgtggtcaagcccctcgacgaccgcttcgccaacgccctgaccgcgctgaacgacatgggcaagatccggaaggacatccagcagtgggagccgtccaagggctggaacgactggacccaggtgcccttctgcagccaccacttccacgagctcatcatgaaggacgggcgcgtgctggtcgtgccctgccggaaccaggacgagctgatcggccgcgcccggatctcccagggggccggctggagcctccgcgagaccgcctgcctggggaagtcctacgcccagatgtggagcctgatgtacttccaccggcgcgacctccggctggcggccaacgccatctgctccgccgtgcccagccactgggtcccgacctcccgcaccacgtggagcatccacgccaagcacgagtggatgaccaccgaggacatgctgaccgtgtggaaccgggtgtggatccgcgagaacccctggatggaggacaagacccccgtcgagtcctgggaggagatcccctacctcggcaagcgggaggaccagtggtgcggcagcctgatcgggctgacgtcccgcgcgacctgggccaagaacatccaggccgccatcaaccaggtgcggagcctcatcggcaacgaggagtacaccgactacatgccgagcatgaagcgcttccggcgcgaggaggaggaggcgggggtgctgtggtga

SEQ ID NO: 9340 - RNA, 9876 nt, synthetic construct
  misc_feature 1..9876: note = derived and/or modified CDS sequence (opt1) from DENV-2__FJ744714__SS-prME
  source 1..9876: mol_type = other RNA
agcgccgggatgatcatcatgctgatccccaccgtgatggccttccacctcaccacccggaacggggagccccacatgatcgtcgggatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcggagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgggtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagcggatcctgggctacagccagatcggggccggcgtgtacaaggagggcaccttccacaccatgtggcacgtgacccgcggggccgtcctcatgcacaagggcaagcggatcgagccctcctgggccgacgtgaagaaggacctgatcagctacgggggcgggtggaagctggagggcgagtggaaggagggcgaggaggtgcaggtcctcgcgctggagcccgggaagaacccccgcgccgtgcagacgaagcccggcctgttcaagaccaacaccgggaccatcggcgccgtgtccctcgacttcagccccgggacgtccggcagccccatcatcgacaagaagggcaaggtcgtggggctgtacggcaacggggtggtcacccggtccggcgcctacgtgagcgccatcgcgcagaccgagaagtccatcgaggacaaccccgagatcgaggacgacatcttccgcaagcggcgcctgaccatcatggacctgcaccccggcgccgggaagacgaagcggtacctccccgccatcgtgcgcgaggccatcaagcggggcctgcgcaccctgatcctcgcgccgacccgggtcgtggccgccgagatggaggaggccctgcgcgggctgcccatccggtaccagacccccgccatccgcgcggagcacacgggccgcgagatcgtggacctcatgtgccacgccaccttcaccatgcggctgctgagccccgtccgcgtgccgaactacaacctcatcatcatggacgaggcccacttcaccgaccccgcctccatcgccgcgcgggggtacatcagcacgcgcgtggagatgggcgaggccgccggcatcttcatgaccgccacgccgcccgggagccgggacccgttcccccagtccaacgcccccatcatcgacgaggagcgcgagatccccgagcggagctggaactccggccacgagtgggtcaccgacttcaaggggaagacggtgtggttcgtgccgagcatcaaggcgggcaacgacatcgccgcctgcctgcgcaagaacgggaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggcgaggagcgcgtcatcctggccgggcccatgccggtgacccacagctccgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacgcccgaggggatcatcccgagcatgttcgagcccgagcgggagaaggtggacgccatcgacggcgagtaccgcctgcgcggcgaggcccggaagaccttcgtcgacctcatgcgccgcggggacctgcccgtgtggctggcctacaaggtggccgcggagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcggggcggaagtccctgaccctcaacctgatcacggagatgggccgcctgcccaccttcatgacccagaagacccgggacgccctcgacaacctggccgtcctgcacacggccgaggcgggcgggcgcgcctacaaccacgccctctccgagctgcccgagaccctggagaccctcctgctgctcaccctgctggccacggtgaccggcgggatcttcctcttcctgatgagcggccggggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcgcacgccccaggacaaccagctcacgtacgtcgtgatcgccatcctgaccgtggtcgccgcgaccatggccaacgagatggggttcctggagaagaccaagaaggacctcggcctggggtccatcgccacgcagcagccggagagcaacatcctggacatcgacctccggcccgcctccgcctggaccctgtacgcggtggccaccaccttcgtgacgcccatgctgcgccacagcatcgagaacagctccgtcaacgtgagcctcaccgccatcgccaaccaggccaccgtgctgatgggcctgggcaaggggtggcccctctccaagatggacatcggcgtcccgctgctggcgatcgggtgctacagccaggtgaaccccatcaccctcacggccgccctgctgctcctggtggcccactacgcgatcatcggccccgggctgcaggccaaggccacccgggaggcccagaagcgcgccgcggccggcatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcggaccacctgggccctctgcgaggccctgaccctggccacgggccccatctccaccctctgggaggggaacccgggccgcttctggaacaccaccatcgcggtgagcatggccaacatcttccgggggtcctacctggccggcgccggcctcctcttcagcatcatgaagaacacgaccaacacccgccgcgggaccggcaacatcggggagacgctgggcgagaagtggaagtcccggctgaacgccctcggcaagagcgagttccagatctacaagaagtccgggatccaggaggtcgaccgcaccctggcgaaggagggcatcaagcgcggggagaccgaccaccacgccgtgagccgcggctccgccaagctgcggtggttcgtggagcgcaacatggtcacccccgaggggaaggtggtggacctcggctgcggccgcggcgggtggagctactactgcgggggcctgaagaacgtccgcgaggtgaaggggctgacgaagggcggccccgggcacgaggagcccatcccgatgtccacctacggctggaacctcgtgcggctgcagagcggggtcgacgtgttcttcatcccgcccgagaagtgcgacaccctgctctgcgacatcggcgagtccagccccaacccgaccgtggaggccgggcgcacgctgcgggtcctgaacctcgtggagaactggctgaacaacaacacccagttctgcatcaaggtgctgaacccctacatgccctccgtcatcgagaagatggaggcgctgcagcgcaagtacggcggcgccctcgtgcggaacccgctgagccgcaacagcacccacgagatgtactgggtgtccaacgccagcgggaacatcgtctccagcgtgaacatgatctcccggatgctgatcaaccgcttcaccatgcggcacaagaaggccacctacgagcccgacgtggacctcggcagcgggacgcgcaacatcggcatcgagtccgaggtccccaacctggacatcatcgggaagcggatcgagaagatcaagcaggagcacgagaccagctggcactacgaccaggaccacccctacaagacctgggcctaccacggctcctacgagaccaagcagacgggcagcgcgtccagcatggtgaacggggtggtccgcctgctcaccaagccgtgggacgtgctgcccaccgtgacccagatggccatgacggacaccacccccttcggccagcagcgcgtcttcaaggagaaggtggacacccggacgcaggagcccaaggaggggaccaagaagctgatgaagatcaccgccgagtggctctggaaggagctgggcaagaagaagaccccgcgcatgtgcacgcgggaggagttcacccgcaaggtgcggtccaacgccgccctgggcgcgatcttcaccgacgagaacaagtggaagtccgcccgcgaggccgtcgaggactcccggttctgggagctcgtggacaaggagcgcaacctgcacctggaggggaagtgcgagacctgcgtctacaacatgatgggcaagcgggagaagaagctcggggagttcggcaaggccaaggggagccgcgccatctggtacatgtggctgggcgcgcggttcctggagttcgaggccctcggcttcctgaacgaggaccactggttctcccgcgagaacagcctgtccggggtggagggcgaggggctccacaagctgggctacatcctgcgggacgtgagcaagaaggagggcggggccatgtacgccgacgacacggcgggctgggacacccgcatcaccctcgaggacctgaagaacgaggagatggtcaccaaccacatggagggggagcacaagaagctggccgaggccatcttcaagctcacgtaccagaacaaggtggtgcgggtccagcgccccacgccccggggcaccgtgatggacatcatcagccgccgggaccagcgcgggtccggccaggtggggacctacggcctgaacacgttcaccaacatggaggcccagctgatccggcagatggagggcgagggggtcttcaagaacatccagcacctcaccgtgaccgaggaggtggccgtccagaactggctggcgcgcgtgggccgcgagcggctgagccgcatggccatctccggggacgactgcgtggtcaagcccctcgacgaccggttcgccaacgccctgacggccctgaacgacatgggcaagatccgcaaggacatccagcagtgggagccgagcaagggctggaacgactggacccaggtgcccttctgctcccaccacttccacgagctcatcatgaaggacgggcgggtgctggtcgtgccctgccgcaaccaggacgagctgatcggccgggcgcgcatcagccagggggccggctggtccctccgggagaccgcctgcctgggcaagagctacgcccagatgtggtccctgatgtacttccaccgccgggacctccgcctggccgcgaacgccatctgcagcgccgtgccctcccactgggtcccgaccagccggacgacctggtccatccacgccaagcacgagtggatgaccaccgaggacatgctgaccgtgtggaaccgcgtgtggatccgggagaacccctggatggaggacaagacgcccgtcgagagctgggaggagatcccctacctcggcaagcgcgaggaccagtggtgcggctccctgatcgggctgaccagccgggccacctgggcgaagaacatccaggccgccatcaaccaggtgcgctccctcatcggcaacgaggagtacaccgactacatgccgagcatgaagcggttccgccgcgaggaggaggaggccggggtgctgtggtga

SEQ ID NO: 9341 - RNA, 9876 nt, synthetic construct
  misc_feature 1..9876: note = derived and/or modified CDS sequence (opt1) from DENV-2__FJ744716__SS-prME
  source 1..9876: mol_type = other RNA
agcgccgggatgatcatcatgctgatccccaccgtgatggccttccacctcaccacccggaacggggagccccacatgatcgtcgggatccaggagaagggcaagagcctgctgttcaagaccgaggacggggtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagcggatcctgggctacagccagatcggggccggcgtgtacaaggagggcaccttccacaccatgtggcacgtgacccgcggggccgtcctcatgcacaagggcaagcggatcgagccctcctgggccgacgtgaagaaggacctgatcagctacgggggcgggtggaagctggagggcgagtggaaggagggcgaggaggtgcaggtcctcgcgctggagcccgggaagaacccccgcgccgtgcagacgaagcccggcctgttcaagaccaacaccgggaccatcggcgccgtgtccctcgacttcagccccgggacgtccggcagccccatcatcgacaagaagggcaaggtcgtggggctgtacggcaacggggtggtcacccggtccggcgcctacgtgagcgccatcgcgcagaccgagaagtccatcgaggacaaccccgagatcgaggacgacatcttccgcaagcggcgcctgaccatcatggacctgcaccccggcgccgggaagacgaagcggtacctccccgccatcgtgcgcgaggccatcaagcggggcctgcgcaccctgatcctcgcgccgacccgggtcgtggccgccgagatggaggaggccctgcgcgggctgcccatccggtaccagacccccgccatccgcgcggagcacacgggccgcgagatcgtggacctcatgtgccacgccaccttcaccatgcggctgctgagccccgtccgcgtgccgaactacaacctcatcatcatggacgaggcccacttcaccgaccccgcctccatcgccgcgcgggggtacatcagcacgcgcgtggagatgggcgaggccgccggcatcttcatgaccgccacgccgcccgggagccgggacccgttcccccagtccaacgcccccatcatcgacgaggagcgcgagatccccgagcggagctggaactccggccacgagtgggtcaccgacttcaaggggaagacggtgtggttcgtgccgagcatcaaggcgggcaacgacatcgccgcctgcctgcgcaagaacgggaagaaggtcatccagctgtcccggaagaccttcgacagcgagtacgtgaagacccgcaccaacgactgggacttcgtggtcacgaccgacatctccgagatgggcgccaacttcaaggcggagcgggtgatcgacccccgccggtgcatgaagcccgtgatcctcaccgacggcgaggagcgcgtcatcctggccgggcccatgccggtgacccacagctccgccgcccagcggcgcggccggatcgggcgcaaccccaagaacgagaacgaccagtacatctacatgggcgagcccctggagaacgacgaggactgcgcccactggaaggaggcgaagatgctcctggacaacatcaacacgcccgaggggatcatcccgagcatgttcgagcccgagcgggagaaggtggacgccatcgacggcgagtaccgcctgcgcggcgaggcccggaagaccttcgtcgacctcatgcgccgcggggacctgcccgtgtggctggcctacaaggtggccgcggagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcggggcggaagtccctgaccctcaacctgatcacggagatgggccgcctgcccaccttcatgacccagaagacccgggacgccctcgacaacctggccgtcctgcgcacggccgaggcgggcgggcgggcctacaaccacgccctctccgagctgcccgagaccctggagaccctcctgctgctcaccctgctggccacggtgaccggcgggatcttcctcttcctgatgagcggccgcggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatggggttcctggagaagaccaagaaggacctcggcctggggtccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctgggcaaggggtggcccctctccaagatggacatcggcgtcccgctgctggcgatcgggtgctacagccaggtgaaccccatcaccctcacggccgccctgctgctcctggtggcccactacgcgatcatcggccccgggctgcaggccaaggccacccgcgaggcccagaagcgggccgcggccggcatcatgaagaaccccaccgtcgacggcatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacgggccccatctccaccctctgggaggggaacccgggccggttctggaacaccaccatcgcggtgagcatggccaacatcttccgcgggtcctacctggccggcgccggcctcctcttcagcatcatgaagaacacgaccaacacccgccgggggaccggcaacatcggggagacgctgggcgagaagtggaagtcccgcctgaacgccctcggcaagagcgagttccagatctacaagaagtccgggatccaggaggtcgaccggaccctggcgaaggagggcatcaagcgcggggagaccgaccaccacgccgtgagccggggctccgccaagctgcgctggttcgtggagcggaacatggtcacccccgaggggaaggtggtggacctcggctgcggccgcgggggctggagctactactgcgggggcctgaagaacgtccgggaggtgaaggggctgacgaagggcggccccgggcacgaggagcccatcccgatgtccacctacggctggaacctcgtgcgcctgcagagcggggtcgacgtgttcttcatcccgcccgagaagtgcgacaccctgctctgcgacatcggcgagtccagccccaacccgaccgtggaggccgggcggacgctgcgcgtcctgaacctcgtggagaactggctgaacaacaacacccagttctgcatcaaggtgctgaacccctacatgccctccgtcatcgagaagatggaggcgctgcagcggaagtacggcggcgccctcgtgcgcaacccgctgagccggaacagcacccacgagatgtactgggtgtccaacgccagcgggaacatcgtctccagcgtgaacatgatctcccgcatgctgatcaaccggttcaccatgcgccacaagaaggccacctacgagcccgacgtggacctcggcagcgggacgcggaacatcggcatcgagtccgaggtccccaacctggacatcatcgggaagcgcatcgagaagatcaagcaggagcacgagaccagctggcactacgaccaggaccacccctacaagacctgggcctaccacggctcctacgagaccaagcagacgggcagcgcgtccagcatggtgaacggggtggtccgcctgctcaccaagccgtgggacgtgctgcccaccgtgacccagatggccatgacggacaccacccccttcggccagcagcgggtcttcaaggagaaggtggacacccgcacgcaggagcccaaggaggggaccaagaagctgatgaagatcaccgccgagtggctctggaaggagctgggcaagaagaagaccccgcggatgtgcacgcgcgaggagttcacccggaaggtgcgctccaacgccgccctgggcgcgatcttcaccgacgagaacaagtggaagtccgcccgggaggccgtcgaggactcccgcttctgggagctcgtggacaaggagcggaacctgcacctggaggggaagtgcgagacctgcgtctacaacatgatgggcaagcgcgagaagaagctcggggagttcggcaaggccaaggggagccgggccatctggtacatgtggctgggcgcgcgcttcctggagttcgaggccctcggcttcctgaacgaggaccactggttctcccgggagaacagcctgtccggggtggagggcgaggggctccacaagctgggctacatcctgcgcgacgtgagcaagaaggagggcggggccatgtacgccgacgacacggcgggctgggacacccggatcaccctcgaggacctgaagaacgaggagatggtcaccaaccacatggagggggagcacaagaagctggccgaggccatcttcaagctcacgtaccagaacaaggtggtgcgcgtccagcggcccacgccccggggcaccgtgatggacatcatcagccggcgcgaccagcgggggtccggccaggtggggacctacggcctgaacacgttcaccaacatggaggcccagctgatccgccagatggagggcgagggggtcttcaagaacatccagcacctcaccgtgaccgaggaggtggccgtccagaactggctggcgcgcgtgggccgggagcgcctgagccggatggccatctccggggacgactgcgtggtcaagcccctcgacgaccgcttcgccaacgccctgacggccctgaacgacatgggcaagatccggaaggacatccagcagtgggagccgagcaagggctggaacgactggacccaggtgcccttctgctcccaccacttccacgagctcatcatgaaggacgggcgcgtgctggtcgtgccctgccggaaccaggacgagctgatcggccgcgcgcggatcagccagggggccggctggtccctccgcgagaccgcctgcctgggcaagagctacgcccagatgtggtccctgatgtacttccaccggcgcgacctccggctggccgcgaacgccatctgcagcgccgtgccctcccactgggtcccgaccagccgcacgacctggtccatccacgccaagcacgagtggatgaccaccgaggacatgctgaccgtgtggaaccgggtgtggatccgcgagaacccctggatggaggacaagacgcccgtcgagagctgggaggagatcccctacctcggcaagcgggaggaccagtggtgcggctccctgatcgggctgaccagccgcgccacctgggcgaagaacatccaggccgccatcaaccaggtgcggtccctcatcggcaacgaggagtacaccgactacatgccgagcatgaagcgcttccgccgggaggaggaggaggccggggtgctgtggtga

SEQ ID NO: 9342 - RNA, 9876 nt, synthetic construct
  misc_feature 1..9876: note = derived and/or modified CDS sequence (opt1) from DENV-2__FJ744718__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcagcccggggcggttctggaacaccaccatcgcggtgtccatggccaacatcttccgcggcagctacctggccggcgccgggctcctcttctccatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgtcccgggggagcgccaagctgcgctggttcgtggagcggaacatggtcacccccgagggcaaggtggtggacctcggctgcgggcgcggcgggtggtcctactactgcggcgggctgaagaacgtccgggaggtgaagggcctgacgaagggcgggcccggccacgaggagcccatcccgatgagcacctacgggtggaacctcgtgcgcctgcagtccggcgtcgacgtgttcttcatcccgcccgagaagtgcgacaccctgctctgcgacatcggggagagctcccccaacccgaccgtggaggccggccggacgctgcgcgtcctgaacctcgtggagaactggctgaacaacaacacccagttctgcatcaaggtgctgaacccctacatgcccagcgtcatcgagaagatggaggcgctgcagcggaagtacggcggggccctcgtgcgcaacccgctgagccggaactccacccacgagatgtactgggtgagcaacgcctccggcaacatcgtcagctccgtgaacatgatcagccgcatgctgatcaaccggttcaccatgcgccacaagaaggccacctacgagcccgacgtggacctcgggtccggcacgcggaacatcgggatcgagagcgaggtccccaacctggacatcatcggcaagcgcatcgagaagatcaagcaggagcacgagacctcctggcactacgaccaggaccacccctacaagacctgggcctaccacggcagctacgagaccaagcagacggggtccgcgagctccatggtgaacggcgtggtccggctgctcaccaagccgtgggacgtgctgcccaccgtgacccagatggccatgacggacaccacccccttcgggcagcagcgcgtcttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgcagcaacgccgccctgggggcgatcttcaccgacgagaacaagtggaagtccgcccgggaggccgtcgaggacagccgcttctgggagctcgtggacaaggagcggaacctgcacctggagggcaagtgcgagacctgcgtctacaacatgatggggaagcgcgagaagaagctcggcgagttcgggaaggccaagggctcccgggccatctggtacatgtggctgggcgcgcgcttcctggagttcgaggccctcgggttcctgaacgaggaccactggttcagccgggagaactccctgagcggcgtggagggggagggcctccacaagctggggtacatcctgcgcgacgtgagcaagaaggagggcggcgccatgtacgccgacgacacggcggggtgggacacccggatcaccctcgaggacctgaagaacgaggagatggtcaccaaccacatggagggcgagcacaagaagctggccgaggccatcttcaagctcacgtaccagaacaaggtggtgcgcgtccagcggcccacgccccgggggaccgtgatggacatcatctcccggcgcgaccagcggggcagcggccaggtggggacctacggcctgaacacgttcaccaacatggaggcccagctgatccgccagatggagggggagggcgtcttcaagaacatccagcacctcaccgtgaccgaggaggtggccgtccagaactggctggcgcgggtggggcgcgagcgcctgtcccggatggccatcagcggcgacgactgcgtggtcaagcccctcgacgaccgcttcgccaacgccctgacggccctgaacgacatgggcaagatccggaaggacatccagcagtgggagccgtccaaggggtggaacgactggacccaggtgcccttctgcagccaccacttccacgagctcatcatgaaggacggccgcgtgctggtcgtgccctgccggaaccaggacgagctgatcgggcgcgcgcggatctcccagggcgccgggtggagcctccgcgagaccgcctgcctgggcaagtcctacgcccagatgtggagcctgatgtacttccaccggcgcgacctccggctggccgcgaacgccatctgctccgccgtgcccagccactgggtcccgacctcccgcacgacctggagcatccacgccaagcacgagtggatgaccaccgaggacatgctgaccgtgtggaaccgggtgtggatccgcgagaacccctggatggaggacaagacgcccgtcgagtcctgggaggagatcccctacctcggcaagcgggaggaccagtggtgcgggagcctgatcggcctgacctcccgcgccacctgggcgaagaacatccaggccgccatcaaccaggtgcggagcctcatcgggaacgaggagtacaccgactacatgccgagcatgaagcgcttccggcgcgaggaggaggaggccggcgtgctgtggtga

SEQ ID NO: 9343 - RNA, 9876 nt, synthetic construct
  misc_feature 1..9876: note = derived and/or modified CDS sequence (opt1) from DENV-2__FJ744722__SS-prME
  source 1..9876: mol_type = other RNA
agcgtgggcatgatcatcatgctgatccccaccgtgatggcgttccacctcaccacccgcaacggggagccccacatgatcgtgagcatccaggagaagggcaagagcctgctgttcaagaccgaggacggggtgaacatgtgcaccctcatggccatggacctgggcgagctgtgcgaggacaccatcacctacaagtgccccctcctgcggcagaacgagcccgaggacatcgactgctggtgcaacagcaccagcacctgggtcacctacgggacgtgcaccaccaccggcgagcaccgccgggagaagcgctccgtggcgctggtgccccacgtcggcatggggctcgagacgcggaccgagacctggatgagctccgagggcgcctggaagcacgcccagcgcatcgagacctggatcctgcggcacccggggttcacgatcatggccgccatcctggcgtacaccatcggcaccacccacttccagcgcacgctcatcttcatcctgctgaccgccgtggcccccagcatgaccatgcggtgcatcgggatctccaaccgcgacttcgtggagggcgtcagcggcgggtcctgggtggacatcgtgctcgagcacggcagctgcgtcaccacgatggccaagaacaagcccaccctggacttcgagctgatcaagaccgaggcgaagcagcccgccaccctccggaagtactgcatcgaggccaagctgacgaacaccaccaccgagtcccgctgccccacgcagggggagcccaacctgaaggaggagcaggacaagcggttcgtgtgcaagcacagcatggtggaccgcggctggggcaacgggtgcggcctcttcgggaagggcgggatcgtgacctgcgccatgttcacgtgcaagaagaacatggagggcaagatcgtgcagcccgagaacctggagtacaccatcgtggtcacgccccactccggcgaggagcacgccgtggggaacgacaccggcaagcacgggaaggagatcaaggtgaccccgcagagctccatcaccgaggcggagctgaccggctacgggacggtcaccatggagtgcagcccccggaccggcctcgacttcaacgagatggtgctgctgcagatggagaacaaggcctggctcgtgcaccgccagtggttcctggacctgcccctcccctggctgccgggcgccgacacccaggggtccaactggatccagaaggagacgctggtcaccttcaagaacccccacgccaagaagcaggacgtggtcgtgctcggcagccaggagggggccatgcacaccgcgctgaccggcgccacggagatccagatgagctccgggaacctcctgttcaccggccacctgaagtgccggctgcgcatggacaagctccagctgaagggcatgagctactccatgtgcaccgggaagttcaaggtggtcaaggagatcgccgagacccagcacggcacgatcgtgatccgggtgcagtacgagggggacggcagcccctgcaagatccccttcgagatcatggacctggagaagcgctacgtcctcggccggctgatcaccgtgaacccgatcgtgaccgagaaggactcccccgtcaacatcgaggccgagccgcccttcggggacagctacatcatcatcggcgtggagccggggcagctgaagctcaactggttcaagaagggctccagcatcgggcagatgttcgagaccacgatgcgcggcgccaagcgcatggcgatcctgggcgacaccgcctgggacttcgggtccctgggcggggtgttcaccagcatcggcaaggccctccaccaggtcttcggggccatctacggcgccgcgttctccggcgtgagctggaccatgaagatcctgatcggggtgatcatcacgtggatcggcatgaactcccggagcacctccctgagcgtctccctggtgctcgtgggggtcgtgaccctgtacctgggcgtgatggtccaggccgacagcgggtgcgtggtgtcctggaagaacaaggagctcaagtgcggcagcggcatcttcatcaccgacaacgtccacacgtggaccgagcagtacaagttccagcccgagagcccctccaagctggccagcgccatccagaaggcgcaggaggaggggatctgcggcatccgctccgtgacccggctggagaacctcatgtggaagcagatcacccccgagctgaaccacatcctggccgagaacgaggtgaagctcacgatcatgaccggggacatcaagggcatcatgcaggccgggaagcgcagcctgcggccgcagcccaccgagctgaagtactcctggaagacctggggcaaggccaagatgctcagcacggagtcccacaaccagaccttcctgatcgacggccccgagaccgccgagtgcccgaacaccaaccgcgcgtggaacagcctggaggtcgaggactacgggttcggcgtgttcacgaccaacatctggctcaagctgaaggagaagcaggacgccttctgcgactccaagctgatgagcgccgccatcaaggacaaccgggccgtgcacgcggacatggggtactggatcgagtccgccctcaacgacacctggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgccggcccctggcacctggggaagctggagatggacttcgacttctgcgacggcacgaccgtcgtggtgaccgaggactgcgggaaccggggcccctccctccgcaccacgaccgcgagcggcaagctgatcaccgagtggtgctgccggagctgcaccctgcccccgctccgctaccgcggggaggacggctgctggtacgggatggagatccgccccctgaaggagaaggaggagaacctggtcaactccctcgtgacggccggccacgggcaggtcgacaacttcagcctgggcgtcctgggcatggccctcttcctggaggagatgctgcggacccgcgtggggaccaagcacgccatcctcctggtggcggtctccttcgtgaccctgatcacgggcaacatgagcttcaaggacctcgggcgggtggtcgtgatggtgggcgccaccatgaccgacgacatcgggatgggcgtcacctacctggccctgctcgccgccttcaaggtgcgccccacgttcgcggccggcctgttcctgcggaagctcacctccaaggagctgatgatgaccaccatcgggatcgtgctgctcagccagtccacgatccccgagaccatcctggagctgaccgacgccctcgccctgggcatgatggtcctgaagatggtgcgcgacatggagaagtaccagctcgccgtcaccatcatggcgatcctgtgcgtgccgaacgccgtgatcctgcagaacgcctggaaggtcagctgcacgatcctcgccgtggtgtccgtcagccccctgctgctcacctccagccagcagaagaccgactggatccccctggccctgaccatcaaggggctcaaccccacggcgatcttcctgaccaccctgtcccgcaccaacaagaagcggagctggccgctcaacgaggccatcatggccgtgggcatggtgtccatcctggccagctccctgctcaagaacgacatccccatgacgggccccctggtcgccgggggcctgctcaccgtgtgctacgtgctgaccgggcgcagcgccgacctggagctcgagcgggccaccgacgtcaagtgggaggaccaggccgagatctccggcagcagccccatcctgtccatcacgatcagcgaggacgggtccatgagcatcaagaacgaggaggaggagcagaccctgaccatcctcatccgcaccggcctgctggtgatctccggcctcttcccggtgagcatccccatcaccgccgcggcctggtacctgtgggaggtcaagaagcagcgggccggggtgctgtgggacgtgcccagcccgccgcccatgggcaaggccgagctcgaggacggggcctaccgcatcaagcagcggggcatcctggggtacagccagatcggcgcgggcgtctacaaggaggggacgttccacaccatgtggcacgtgacccgcggcgccgtgctgacccacaaggggaagcggatcgagccctcctgggccgacgtcaagaaggacctcatcagctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgtccctggacttcagccccggcacgtccggcagccccatcatcgacaagaaggggaaggtggtcggcctctacgggaacggcgtggtgacccggtccggcgcctacgtcagcgccatcgcccagaccgagaagtccatcgaggacaaccccgacatcgaggacgacatcttccgcaagcggcgcctgaccatcatggacctgcaccccggggccggcaagacgaagcggtacctgcccgcgatcgtgcgcgaggccatcaagcgggggctccgcaccctgatcctggccccgacccgggtggtcgccgcggagatggaggaggccctccgcggcctgcccatccggtaccagacccccgccatccgcgccgagcacacggggcgcgagatcgtggacctgatgtgccacgccaccttcaccatgcggctcctgagccccgtgcgcgtcccgaactacaacctgatcatcatggacgaggcgcacttcaccgaccccgcctccatcgccgcccggggctacatcagcacgcgcgtggagatgggcgaggccgcggggatcttcatgaccgccacgccgcccggcagccgggacccgttcccccagtccaacgcccccatcatcgacgaggagcgcgagatccccgagcggagctggaactccgggcacgagtgggtgaccgacttcaagggcaagacggtctggttcgtgccgagcatcaaggccgggaacgacatcgccgcgtgcctccgcaagaacggcaagaaggtgatccagctgtcccggaagaccttcgacagcgagtacgtcaagacccgcaccaacgactgggacttcgtggtgacgaccgacatctccgagatgggcgccaacttcaaggccgagcgggtcatcgacccccgccggtgcatgaagcccgtgatcctgaccgacggggaggagcgcgtgatcctcgccggccccatgccggtcacccacagctccgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacgcccgagggcatcatcccgagcatgttcgagcccgagcgggagaaggtggacgccatcgacggcgagtaccgcctgcgcggggaggcgcggaagaccttcgtggacctgatgcgccggggcgacctccccgtctggctggcctacaaggtggccgccgaggggatcaactacgccgaccgccggtggtgcttcgacggcatcaagaacaaccagatcctggaggagaacgtcgaggtggagatctggaccaaggagggggagcgcaagaagctcaagccgcggtggctggacgcgcgcatctactccgaccccctggccctcaaggagttcaaggagttcgccgccggccggaagtccctgaccctgaacctcatcacggagatgggccgcctgcccaccttcatgacccagaagacccgggacgccctggacaacctcgcggtgctgcacacggccgaggccgggggccgcgcctacaaccacgcgctgtccgagctccccgagaccctggagaccctgctcctgctgaccctcctggccaccgtcaccgggggcatcttcctgttcctcatgagcggccgggggatcggcaagatgaccctggggatgtgctgcatcgtgaccgcctccatcctgctctggtacgcccagatccagccgcactggatcgccgcgagcatcatcctggagttcttcctgatcgtgctcctgatccccgagcccgagaagcagcgcacgccccaggacaaccagctgacgtacgtcgtgatcgccatcctcaccgtggtcgccgccaccatggccaacgagatgggcttcctggagaagaccaagaaggacctggggctcggctccatcgcgacgcagcagccggagagcaacatcctggacatcgacctgcggcccgcctccgcctggaccctctacgccgtggccaccaccttcgtgacgcccatgctgcgccacagcatcgagaacagctccgtcaacgtgagcctgaccgcgatcgccaaccaggccaccgtgctcatgggcctggggaagggctggcccctgtccaagatggacatcggggccccgctcctggccatcggctgctacagccaggtcaaccccatcaccctgacggcggccctcctgctgctcgtggcccactacgccatcatcgggcccggcctgcaggcgaaggccacccgggaggcccagaagcgcgccgccgcgggcatcatgaagaaccccaccgtggacgggatcaccgtcatcgacctggacccgatcccctacgaccccaagttcgagaagcagctcggccaggtgatgctgctggtgctctgcgtcacccaggtgctgatgatgcggaccacctgggccctgtgcgaggccctcaccctggccacggggcccatctccaccctgtgggagggcaacccggggcgcttctggaacaccaccatcgccgtgagcatggcgaacatcttccggggctcctacctcgccggcgccgggctgctgttcagcatcatgaagaacacgaccaactcccgccgcggcaccgggaacatcggcgagaccctcggcgagaagtggaagtcccggctgaacgccctggggaagtccgagttccagatctacaagaagtccggcatccaggaggtcgaccgcacgctcgccaaggaggggatcaagcggggcgagaccgaccaccacgcggtgtcccgcgggagcgccaagctgcggtggttcgtggagcgcaacatggtcacccccgagggcaaggtggtggacctgggctgcgggcggggcgggtggtcctactactgcggcgggctcaagaacgtccgcgaggtgaagggcctgaccaagggcgggcccggccacgaggagcccatcccgatgagcacgtacgggtggaacctggtgcggctccagtccggcgtcgacgtgttcttcatcccgcccgagaagtgcgacaccctgctgtgcgacatcggggagagctcccccaacccgaccgtggaggccggccgcaccctccgggtcctgaacctggtggagaactggctcaacaacaacacccagttctgcatcaaggtgctgaacccctacatgcccagcgtcatcgagaagatggagacgctgcagcgcaagtacggcggggccctggtgcggaacccgctcagccgcaactccacccacgagatgtactgggtgagcaacgcgtccggcaacatcgtcagctccgtgaacatgatcagccggatgctgatcaaccgcttcaccatgcggcacaagaaggccacctacgagcccgacgtggacctggggtccggcacgcgcaacatcgggatcgagagcgagatccccaacctcgacatcatcggcaagcggatcgagaagatcaagcaggagcacgagacctcctggcactacgaccaggaccacccctacaagacctgggcctaccacggcagctacgagaccaagcagacggggtccgccagctccatggtcaacggcgtggtgcgcctgctgaccaagccgtgggacgtcctccccaccgtgacccagatggccatgacggacaccacccccttcgggcagcagcgcgtgttcaaggagaaggtcgacacccggacgcaggagcccaaggagggcaccaagaagctgatgaagatcaccgcggagtggctgtggaaggagctcggcaagaagaagaccccgcgcatgtgcacgcgggaggagttcacccgcaaggtgcggagcaacgccgccctgggggccatcttcaccgacgagaacaagtggaagtccgcccgcgaggcggtcgaggacagccggttctgggagctggtggacaaggagcgcaacctccacctggagggcaagtgcgagacctgcgtgtacaacatgatggggaagcgggagaagaagctgggcgagttcgggaaggccaagggctcccgcgccatctggtacatgtggctcggcgcccggttcctggagttcgaggccctggggttcctcaacgaggaccactggttcagccgcgagaactccctgagcggcgtcgagggggagggcctgcaccggctcgggtacatcctgcgcgacgtgagcaagaaggagggcggcgcgatgtacgccgacgacacggccgggtgggacacccggatcaccctggaggacctcaagaacgaggagatggtgaccaaccacatggagggcgagcacaagaagctggccgaggcgatcttcaagctgacgtaccagaacaaggtcgtgcgcgtgcagcggcccacgccccgggggaccgtcatggacatcatctcccggcgcgaccagcggggcagcggccaggtggggacctacggcctcaacacgttcaccaacatggaggcccagctgatccgccagatggagggggagggcgtgttcaagaacatccagcacctgaccgtcaccgaggagatcgccgtgcagaactggctcgcccgcgtggggcgggagcgcctgtcccggatggccatcagcggcgacgactgcgtcgtgaagcccctggacgaccgcttcgcgtccgccctcacggccctgaacgacatgggcaagatccggaaggacatccagcagtgggagccgagccgcgggtggaacgactggacccaggtgcccttctgctcccaccacttccacgagctgatcatgaaggacggccgggtcctcgtggtgccctgccgcaaccaggacgagctgatcgggcgggcccgcatcagccagggcgccgggtggtccctgcgggagaccgcgtgcctcggcaagagctacgcccagatgtggtccctgatgtacttccaccgccgggacctgcgcctcgccgccaacgccatctgcagcgcggtcccctcccactgggtgccgaccagccggaccacgtggtccatccacgccaagcacgagtggatgaccaccgaggacatgctgaccgtgtggaaccgcgtctggatccaggagaacccctggatggaggacaagacgcccgtggagagctgggaggagatcccctacctgggcaagcgggaggaccagtggtgcgggtccctcatcggcctgaccagccgcgccacctgggccaagaacatccaggtggccatcaaccaggtccggagcctgatcgggaacgaggagtacaccgactacatgccgtccatgaagcgcttccgccgggaggaggaggaggcgggcgtgctctggtga

SEQ ID NO: 9344 - RNA, 9876 nt, synthetic construct
  misc_feature 1..9876: note = derived and/or modified CDS sequence (opt1) from DENV-2__FJ744723__SS-prME
  source 1..9876: mol_type = other RNA
agcgtgggcatgatcatcatgctgatccccaccgtgatggcgttccacctcaccacccgcaacggggagccccacatgatcgtgagcatccaggagaagggcaagagcctgctgttcaagaccgaggacggggtgaacatgtgcaccctcatggccatggacctgggcgagctgtgcgaggacaccatcacctacaagtgccccctcctgcggcagaacgagcccgaggacatcgactgctggtgcaactccaccagcacctgggtcacctacgggacgtgcaccaccaccggcgagcaccgccgggagaagcgctccgtggcgctggtgccccacgtcggcatggggctcgagacgcggaccgagacctggatgagctccgagggcgcctggaagcacgcccagcgcatcgagacctggatcctgcggcacccggggttcacgatcatggccgccatcctggcgtacaccatcggcaccacccacttccagcgcacgctcatcttcatcctgctgaccgccgtggcccccagcatgaccatgcggtgcatcgggatctccaaccgcgacttcgtggagggcgtcagcggcgggtcctgggtggacatcgtgctcgagcacggcagctgcgtcaccacgatggccaagaacaagcccaccctggacttcgagctgatcaagaccgaggcgaagcagcccgccaccctccggaagtactgcatcgaggccaagctgacgaacaccaccaccgagtcccgctgccccacgcagggggagcccagcctgaaggaggagcaggacaagcggttcgtgtgcaagcactccatggtggaccgcggctggggcaacgggtgcggcctcttcgggaagggcgggatcgtgacctgcgccatgttcacgtgcaagaagaacatggagggcaagatcgtgcagcccgagaacctggagtacaccatcgtggtcacgccccacagcggcgaggagcacgccgtggggaacgacaccggcaagcacgggaaggagatcaaggtgaccccgcagtccagcatcaccgaggcggagctgaccggctacgggacggtcaccatggagtgcagcccccggaccggcctcgacttcaacgagatggtgctgctgcagatggagaacaaggcctggctcgtgcaccgccagtggttcctggacctgcccctcccctggctgccgggcgccgacacccaggggagcaactggatccagaaggagacgctggtcaccttcaagaacccccacgccaagaagcaggacgtggtcgtgctcggcagccaggagggggccatgcacaccgcgctgaccggcgccacggagatccagatgtccagcgggaacctcctgttcaccggccacctgaagtgccggctgcgcatggacaagctccagctgaagggcatgtcctacagcatgtgcaccgggaagttcaaggtggtcaaggagatcgccgagacccagcacggcacgatcgtgatccgggtgcagtacgagggggacggctccccctgcaagatccccttcgagatcatggacctggagaagcgctacgtcctcggccggctgatcaccgtgaacccgatcgtgaccgagaaggacagccccgtcaacatcgaggccgagccgcccttcggggactcctacatcatcatcggcgtggagccggggcagctgaagctcaactggttcaagaagggcagctccatcgggcagatgttcgagaccacgatgcgcggcgccaagcgcatggcgatcctgggcgacaccgcctgggacttcgggagcctgggcggggtgttcacctccatcggcaaggccctccaccaggtcttcggggccatctacggcgccgcgttcagcggcgtgtcctggaccatgaagatcctgatcggggtgatcatcacgtggatcggcatgaacagccggtccaccagcctgtccgtcagcctggtgctcgtgggggtcgtgaccctgtacctgggcgtgatggtccaggccgactccgggtgcgtggtgagctggaagaacaaggagctcaagtgcggcagcggcatcttcatcaccgacaacgtccacacgtggaccgagcagtacaagttccagcccgagtcccccagcaagctggcctccgccatccagaaggcgcaggaggaggggatctgcggcatccgcagcgtgacccggctggagaacctcatgtggaagcagatcacccccgagctgaaccacatcctggccgagaacgaggtgaagctcacgatcatgaccggggacatcaagggcatcatgcaggccgggaagcgctccctgcggccgcagcccaccgagctgaagtacagctggaagacctggggcaaggccaagatgctctccacggagagccacaaccagaccttcctgatcgacggccccgagaccgccgagtgcccgaacaccaaccgcgcgtggaactccctggaggtcgaggactacgggttcggcgtgttcacgaccaacatctggctcaagctgaaggagaagcaggacgccttctgcgacagcaagctgatgtccgccgccatcaaggacaaccgggccgtgcacgcggacatggggtactggatcgagagcgccctcaacgacacctggaagatcgagaaggcctccttcatcgaggtcaagaactgccactggcccaagagccacaccctgtggtccaacggcgtgctggagagcgagatgatcatccccaagaacctcgccggccccgtgtcccagcacaactaccgcccggggtaccacacccagatcgccggcccctggcacctggggaagctggagatggacttcgacttctgcgacggcacgaccgtcgtggtgaccgaggactgcgggaaccggggccccagcctccgcaccacgaccgcgagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgacggccggccacgggcaggtcgacaacttctccctgggcgtcctgggcatggccctcttcctggaggagatgctgcggacccgcgtggggaccaagcacgccatcctcctggtggcggtcagcttcgtgaccctgatcacgggcaacatgtccttcaaggacctcgggcgggtggtcgtgatggtgggcgccaccatgaccgacgacatcgggatgggcgtcacctacctggccctgctcgccgccttcaaggtgcgccccacgttcgcggccggcctgttcctgcggaagctcaccagcaaggagctgatgatgaccaccatcgggatcgtgctgctctcccagagcacgatccccgagaccatcctggagctgaccgacgccctcgccctgggcatgatggtcctgaagatggtgcgcgacatggagaagtaccagctcgccgtcaccatcatggcgatcctgtgcgtgccgaacgccgtgatcctgcagaacgcctggaaggtctcctgcacgatcctcgccgtggtgagcgtcagccccctgctgctcaccagctcccagcagaagaccgactggatccccctggccctgaccatcaaggggctcaaccccacggcgatcttcctgaccaccctgagccgcaccaacaagaagcggtcctggccgctcaacgaggccatcatggccgtgggcatggtgagcatcctggcctccagcctgctcaagaacgacatccccatgacgggccccctggtcgccggcgggctgctcaccgtgtgctacgtgctgaccgggcgctccgccgacctggagctcgagcgggccaccgacgtcaagtgggaggaccaggccgagatcagcgggagctcccccatcctgagcatcacgatctccgaggacgggagcatgtccatcaagaacgaggaggaggagcagaccctgaccatcctcatccgcaccggcctgctggtgatcagcggcctcttcccggtgtccatccccatcaccgccgcggcctggtacctgtgggaggtcaagaagcagcgggccggggtgctgtgggacgtgccctccccgccgcccatgggcaaggccgagctcgaggacggggcctaccgcatcaagcagcggggcatcctggggtactcccagatcggcgcgggcgtctacaaggaggggacgttccacaccatgtggcacgtgacccgcggcgccgtgctgacccacaaggggaagcggatcgagcccagctgggccgacgtcaagaaggacctcatctcctacggcgggggctggaagctggagggcgagtggaaggagggggaggaggtccaggtgctggccctcgagcccggcaagaacccccgcgccgtccagacgaagcccgggctgttcaagaccaacaccggcaccatcggggcggtgagcctggacttctcccccggcacgagcggctcccccatcatcgacaagaaggggaaggtggtcggcctctacgggaacggcgtggtgacccggagcggcgcctacgtctccgccatcgcccagaccgagaagtccatcgaggacaaccccgacatcgaggacgacatcttccgcaagcggcgcctgaccatcatggacctgcaccccggggccggcaagacgaagcggtacctgcccgcgatcgtgcgcgaggccatcaagcgggggctccgcaccctgatcctggccccgacccgggtggtcgccgcggagatggaggaggccctccgcggcctgcccatccggtaccagacccccgccatccgcgccgagcacacggggcgcgagatcgtggacctgatgtgccacgccaccttcaccatgcggctcctgtcccccgtgcgcgtcccgaactacaacctgatcatcatggacgaggcgcacttcaccgaccccgccagcatcgccgcccggggctacatcagcacgcgcgtggagatgggcgaggccgcggggatcttcatgaccgccacgccgcccggctcccgggacccgttcccccagagcaacgcccccatcatcgacgaggagcgcgagatccccgagcggtcctggaacagcgggcacgagtgggtgaccgacttcaagggcaagacggtctggttcgtgccgtccatcaaggccgggaacgacatcgccgcgtgcctccgcaagaacggcaagaaggtgatccagctgagccggaagaccttcgactccgagtacgtcaagacccgcaccaacgactgggacttcgtggtgacgaccgacatcagcgagatgggcgccaacttcaaggccgagcgggtcatcgacccccgccggtgcatgaagcccgtgatcctgaccgacggggaggagcgcgtgatcctcgccggccccatgccggtcacccactccagcgcggcccagcggcgcgggcggatcggccgcaaccccaagaacgagaacgaccagtacatctacatgggggagcccctggagaacgacgaggactgcgcccactggaaggaggccaagatgctgctcgacaacatcaacacgcccgagggcatcatcccgtccatgttcgagcccgagcgggagaaggtggacgccatcgacggcgagtaccgcctgcgcggggaggcgcggaagaccttcgtggacctgatgcgccggggcgacctccccgtctggctggcctacaaggtggccgccgaggggatcaactacgccgaccgccggtggtgcttcgacggcatcaagaacaaccagatcctggaggagaacgtcgaggtggagatctggaccaaggagggggagcgcaagaagctcaagccgcggtggctggacgcgcgcatctacagcgaccccctggccctcaaggagttcaaggagttcgccgccggccggaagtccctgaccctgaacctcatcacggagatgggccgcctgcccaccttcatgacccagaagacccgggacgccctggacaacctcgcggtgctgcacacggccgaggccgggggccgcgcctacaaccacgcgctgagcgagctccccgagaccctggagaccctgctcctgctgaccctcctggccaccgtcaccgggggcatcttcctgttcctcatgtccggccgggggatcggcaagatgaccctggggatgtgctgcatcgtgaccgccagcatcctgctctggtacgcccagatccagccgcactggatcgccgcgtccatcatcctggagttcttcctgatcgtgctcctgatccccgagcccgagaagcagcgcacgccccaggacaaccagctgacgtacgtcgtgatcgccatcctcaccgtggtcgccgccaccatggccaacgagatgggcttcctggagaagaccaagaaggacctggggctcggcagcatcgcgacgcagcagccggagtccaacatcctggacatcgacctgcggcccgccagcgcctggaccctctacgccgtggccaccaccttcgtgacgcccatgctgcgccacagcatcgagaactccagcgtcaacgtgtccctgaccgcgatcgccaaccaggccaccgtgctcatgggcctggggaagggctggcccctgagcaagatggacatcggggccccgctcctggccatcggctgctactcccaggtcaaccccatcaccctgacggcggccctcctgctgctcgtggcccactacgccatcatcgggcccggcctgcaggcgaaggccacccgggaggcccagaagcgcgccgccgcgggcatcatgaagaaccccaccgtggacgggatcaccgtcatcgacctggacccgatcccctacgaccccaagttcgagaagcagctcggccaggtgatgctgctggtgctctgcgtcacccaggtgctgatgatgcggaccacctgggccctgtgcgaggccctcaccctggccacggggcccatcagcaccctgtgggagggcaacccggggcgcttctggaacaccaccatcgccgtgtccatggcgaacatcttccggggcagctacctcgccggcgccgggctgctgttctccatcatgaagaacacgaccaacagccgccgcggcaccgggaacatcggcgagaccctcggcgagaagtggaagtcccggctgaacgccctgggcaagagcgagttccagatctacaagaagtccggcatccaggaggtcgaccgcacgctcgccaaggaggggatcaagcggggcgagaccgaccaccacgcggtgagccgcgggtccgccaagctgcggtggttcgtggagcgcaacatggtcacccccgagggcaaggtggtggacctgggctgcgggcggggcgggtggagctactactgcggcgggctcaagaacgtccgcgaggtgaagggcctgaccaagggcgggcccggccacgaggagcccatcccgatgtccacgtacgggtggaacctggtgcggctccagagcggcgtcgacgtgttcttcatcccgcccgagaagtgcgacaccctgctgtgcgacatcggggagtccagccccaacccgaccgtggaggccggccgcaccctccgggtcctgaacctggtggagaactggctcaacaacaacacccagttctgcatcaaggtgctgaacccctacatgcccagcgtcatcgagaagatggagacgctgcagcgcaagtacggcggggccctggtgcggaacccgctctcccgcaacagcacccacgagatgtactgggtgtccaacgcgagcggcaacatcgtctccagcgtgaacatgatctcccggatgctgatcaaccgcttcaccatgcggcacaagaaggccacctacgagcccgacgtggacctggggagcggcacgcgcaacatcgggatcgagtccgagatccccaacctcgacatcatcggcaagcggatcgagaagatcaagcaggagcacgagaccagctggcactacgaccaggaccacccctacaagacctgggcctaccacggctcctacgagaccaagcagacggggagcgcctccagcatggtcaacggcgtggtgcgcctgctgaccaagccgtgggacgtcctccccaccgtgacccagatggccatgacggacaccacccccttcgggcagcagcgcgtgttcaaggagaaggtcgacacccggacgcaggagcccaaggagggcaccaagaagctgatgaagatcaccgcggagtggctgtggaaggagctcggcaagaagaagaccccgcgcatgtgcacgcgggaggagttcacccgcaaggtgcggtccaacgccgccctgggggccatcttcaccgacgagaacaagtggaagtccgcccgcgaggcggtcgaggactcccggttctgggagctggtggacaaggagcgcaacctccacctggagggcaagtgcgagacctgcgtgtacaacatgatggggaagcgggagaagaagctgggcgagttcgggaaggccaagggcagccgcgccatctggtacatgtggctcggcgcccggttcctggagttcgaggccctggggttcctcaacgaggaccactggttctcccgcgagaacagcctgagcggcgtcgagggggagggcctgcaccggctcgggtacatcctgcgcgacgtgtccaagaaggagggcggcgcgatgtacgccgacgacacggccgggtgggacacccggatcaccctggaggacctcaagaacgaggagatggtgaccaaccacatggagggcgagcacaagaagctggccgaggcgatcttcaagctgacgtaccagaacaaggtcgtgcgcgtgcagcggcccacgccccgggggaccgtcatggacatcatcagccggcgcgaccagcggggctccggccaggtggggacctacggcctcaacacgttcaccaacatggaggcccagctgatccgccagatggagggggagggcgtgttcaagaacatccagcacctgaccgtcaccgaggagacggccgtgcagaactggctcgcccgcgtggggcgggagcgcctgagccggatggccatctccggcgacgactgcgtcgtgaagcccctggacgaccgcttcgcgagcgccctcaccgccctgaacgacatgggcaagatccggaaggacatccagcagtgggagccgtcccgcgggtggaacgactggacccaggtgcccttctgcagccaccacttccacgagctgatcatgaaggacggccgggtcctcgtggtgccctgccgcaaccaggacgagctgatcgggcgggcccgcatctcccagggcgccgggtggagcctgcgggagaccgcgtgcctcggcaagtcctacgcccagatgtggagcctgatgtacttccaccgccgggacctgcgcctcgccgccaacgccatctgctccgcggtccccagccactgggtgccgacctcccggacgacctggagcatccacgccaagcacgagtggatgaccaccgaggacatgctgacggtgtggaaccgcgtctggatccaggagaacccctggatggaggacaagacccccgtggagtcctgggaggagatcccctacctgggcaagcgggaggaccagtggtgcgggagcctcatcggcctgaccagccgcgccacctgggccaagaacatccaggtggccatcaaccaggtccggtccctgatcgggaacgaggagtacacggactacatgccgagcatgaagcgcttccgccgggaggaggaggaggcgggcgtgctctggtga

SEQ ID NO: 9345 - RNA, 9876 nt, synthetic construct
  misc_feature 1..9876: note = derived and/or modified CDS sequence (opt1) from DENV-2__FJ744724__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatcgtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccgtcaccgaggccgagctgaccgggtacggcaccgtgacgatggagtgcagcccccggaccggcctcgacttcaacgagatggtgctgctgcagatggagaacaaggcctggctcgtccaccgccagtggttcctggacctgcccctcccctggctgccgggggccgacaagcaggagtccaactggatccagaaggagaccctggtgaccttcaagaacccccacgccaagaagcaggacgtcgtggtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtcgtgaaggagatcgccgagacccagcacggcaccatcgtgatccgggtccagtacgagggggacggcagcccctgcaagatccccttcgagatcatggacctggagaagcgctacgtgctcggccggctgatcaccgtgaacccgatcgtcacggagaaggactcccccgtgaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtcttcacgagcatcggcaaggccctccaccaggtgttcggggccatctacggcgcggccttctccggcgtgagctggaccatgaagatcctgatcggggtcatcatcacctggatcggcatgaactcccggagcacctccctgagcgtgtccctggtgctcgtcgggatcgtgacgctgtacctgggcgtgatggtccaggccgacagcgggtgcgtggtgtcctggaagaacaaggagctcaagtgcggcagcggcatcttcatcaccgacaacgtccacacctggaccgagcagtacaagttccagcccgagagcccctccaagctggccagcgcgatccagaaggcccaggaggaggggatctgcggcatccgctccgtgacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtcgaggactacgggttcggcgtgttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtcgtggtgacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtcaactccctcgtgaccgccggccacgggcagatcgacaacttcagcctgggcgtgctgggcatggccctcttcctggaggagatgctgcggacccgcgtcgggacgaagcacgcgatcctcctggtggccgtgtccttcgtcaccctgatcaccggcaacatgagcttcaaggacctcgggcgggtggtggtcatggtgggcgccaccatggccgacgacatcgggatgggcgtgacgtacctggccctgctcgcggccttcaaggtccgccccaccttcgccgccggcctgctgctccggaagctgacctccaaggagctgatgatgaccacgatcgggatcgtgctcctgagccagtccaccatccccgagaccgtgctggagctcaccgacgccctggcgctgggcatgatggtcctcaagatcgtgcgcgacatggagaagtaccagctggccgtcacgatcatggccatcctgtgcgtgccgaacgccgtgatcctccagaacgcctggaaggtcagctgcaccatcctggcggtggtgtccgtcagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtgggcatggtgtccatcctggccagctccctcctgaagaacgacatccccatgaccggccccctggtcgccgggggcctcctgaccgtgtgctacgtgctgaccgggcgcagcgccgacctcgagctggagcgggccacggacgtcaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtgatctccggcctgttcccgatcagcatccccatcaccgccgccgcctggtacctgtgggaggtgaagaagcagcgggccggggtcctctgggacgtgcccagcccgccgcccatgggcaaggcggagctggaggacggggcctaccgcatcaagcagaagggcatcctggggtacagccagatcggcgccggcgtgtacaaggaggggaccttccacaccatgtggcacgtcacccggggcgccgtgctcatgcacaaggggaagcgcatcgagccctcctgggccgacgtgaagaaggacctgatcagctacggcgggggctggaagctggagggcgagtggaaggagggggaggaggtccaggtgctcgcgctggagcccggcaagaacccccgggccgtgcagacgaagcccgggctgttcaagaccaacaccggcaccatcggggccgtctccctcgacttcagccccggcacgtccggcagccccatcatcgacaagaaggggaaggtggtgggcctgtacgggaacggcgtcgtgacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtccgggaggccatcaagcgcgggctgcggaccctgatcctcgcgccgacccgcgtggtggccgccgagatggaggaggccctgcggggcctgcccatccgctaccagacccccgccatccgggcggagcacacggggcgcgagatcgtcgacctcatgtgccacgccaccttcaccatgcgcctgctgagccccgtgcgggtgccgaactacaacctcatcatcatggacgaggcccacttcaccgaccccgcctccatcgccgcgcgcggctacatcagcacgcgggtcgagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtgaccgacttcaagggcaagacggtgtggttcgtcccgagcatcaaggcggggaacgacatcgccgcctgcctgcggaagaacggcaagaaggtgatccagctgtcccgcaagaccttcgacagcgagtacgtgaagacccggaccaacgactgggacttcgtcgtgacgaccgacatctccgagatgggcgccaacttcaaggcggagcgcgtgatcgacccccggcgctgcatgaagcccgtcatcctcaccgacggggaggagcgggtgatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtcgacgccatcgacggcgagtaccggctgcgcggggaggcccgcaagaccttcgtggacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtgctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtcctgctgatccccgagcccgagaagcagcggacgccccaggacaaccagctcacgtacgtggtgatcgccatcctgaccgtcgtggccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtcacgcccatgctgcggcacagcatcgagaacagctccgtgaacgtgagcctcaccgccatcgccaaccaggccaccgtcctgatgggcctggggaagggctggcccctctccaagatggacatcggggtgccgctgctggcgatcggctgctacagccaggtgaaccccatcaccctcacggccgccctgctgctcctggtcgcccactacgcgatcatcgggcccggcctgcaggccaaggccacccgcgaggcccagaagcgggccgcggccggcatcatgaagaaccccaccgtggacgggatcaccgtgatcgacctcgacccgatcccctacgaccccaagttcgagaagcagctgggccaggtcatgctgctcatcctgtgcgtgacccaggtgctgatgatgcgcaccacctgggccctctgcgaggccctgaccctggccacggggcccatctccaccctctgggagggcaacccggggcggttctggaacaccaccatcgcggtcagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtggaccggaccctggcgaaggaggggatcaagcgcggcgagaccgaccaccacgccgtgagccgggggtccgccaagctgcgctggttcgtcgagcggaacatggtgacccccgagggcaaggtggtcgacctcggctgcgggcgcggcgggtggagctactactgcggcgggctgaagaacgtgcgggaggtgaagggcctgacgaagggcgggcccggccacgaggagcccatcccgatgtccacctacgggtggaacctcgtccgcctgcagagcggcgtggacgtgttcttcatcccgcccgagaagtgcgacaccctgctctgcgacatcggggagtccagccccaacccgaccgtcgaggccggccggacgctgcgcgtgctgaacctcgtggagaactggctgaacaacaacacccagttctgcatcaaggtcctgaacccctacatgccctccgtgatcgagaagatggaggcgctgcagcggaagtacggcggggccctcgtgcgcaacccgctgagccggaacagcacccacgagatgtactgggtctccaacgccagcggcaacatcgtgtccagcgtgaacatgatctcccgcatgctgatcaaccggttcaccatgcgccacaagaaggccacctacgagcccgacgtcgacctcgggagcggcacgcggaacatcgggatcgagtccgaggtgcccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtgaacggcgtcgtgcggctgctcaccaagccgtgggacgtgctgcccaccgtcacccagatggccatgacggacaccacccccttcgggcagcagcgcgtgttcaaggagaaggtggacacccgcacgcaggagcccaaggagggcaccaagaagctgatgaagatcaccgccgagtggctctggaaggagctgggcaagaagaagaccccgcggatgtgcacgcgcgaggagttcacccggaaggtccgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtggagggggagggcctccacaagctggggtacatcctgcgcgacgtcagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtggtccgcgtgcagcggcccacgccccgggggaccgtgatggacatcatcagccggcgcgaccagcggggctccgggcaggtcggcacctacggcctgaacacgttcaccaacatggaggcccagctgatccgccagatggagggggagggcgtgttcaagaacatccagcacctcaccgtgaccgaggaggtcgccgtgcagaactggctggcgcgggtggggcgcgagcgcctgagccggatggccatctccggcgacgactgcgtcgtgaagcccctcgacgaccgcttcgccaacgccctgacggccctgaacgacatgggcaagatccggaaggacatccagcagtgggagccgagcaaggggtggaacgactggacccaggtgcccttctgctcccaccacttccacgagctcatcatgaaggacggccgcgtcctggtggtgccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtcccctcccactgggtgccgaccagccgcacgacctggtccatccacgccaagcacgagtggatgaccaccgaggacatgctgaccgtgtggaaccgggtctggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccagaccgccatcaaccaggtgcggtccctcatcgggaacgaggagtacacggactacatgccgagcatgaagcgcttccggcgcgaggaggaggaggccggcgtcctgtggtga

SEQ ID NO: 9346 - RNA, 9876 nt, synthetic construct
  misc_feature 1..9876: note = derived and/or modified CDS sequence (opt1) from DENV-2__FJ906957__SS-prME
  source 1..9876: mol_type = other RNA
agcgcgggcatgatcatcatgctgatccccaccgtgatggccttccacctcaccacccgcaacggggagccccacatgatcgtgagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcacccggggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacaagcaggggagcaactggatccagaaggagaccctggtgaccttcaagaacccccacgcgaagaagcaggacgtcgtggtcctcggcagccaggagggggccatgcacacggccctgaccggcgccaccgagatccagatgtccagcgggaacctcctgttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgctacgtgctcggccggctgatcaccgtcaacccgatcgtgacggagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcgcatggccatcctgggcgacaccgcctgggacttcgggagcctgggcggggtgttcacgtccatcggcaaggccctccaccaggtgttcggggcgatctacggcgccgccttcagcggcgtctcctggaccatgaagatcctgatcggggtgatcatcacctggatcggcatgaacagccggtccaccagcctgtccgtgagcctggtcctcgtggggatcgtgacgctgtacctgggcgtcatggtgcaggccgactccgggtgcgtggtcagctggaagaacaaggagctcaagtgcggcagcggcatcttcatcaccgacaacgtgcacacctggaccgagcagtacaagttccagcccgagtcccccagcaagctggcgtccgccatccagaaggcccaggaggaggggatctgcggcatccgcagcgtgacgcggctggagaacctcatgtggaagcagatcacccccgagctgaaccacatcctggccgagaacgaggtcaagctcaccatcatgaccggggacatcaagggcatcatgcaggccgggaagcgctccctgcggccgcagcccacggagctgaagtacagctggaagacctggggcaaggcgaagatgctctccaccgagagccacaaccagaccttcctgatcgacggccccgagacggccgagtgcccgaacaccaaccgcgcctggaactccctggaggtggaggactacgggttcggcgtgttcaccaccaacatctggctcaagctgaaggagaagcaggacgccttctgcgacagcaagctgatgtccgccgcgatcaaggacaaccgggccgtccacgccgacatggggtactggatcgagagcgccctcaacgacacgtggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccgcccggggtaccacacccagatcgccggcccctggcacctggggaagctggagatggacttcgacttctgcgacggcaccaccgtggtggtcacggaggactgcgggaaccggggccccagcctccgcaccaccaccgccagcggcaagctgatcacggagtggtgctgccggtcctgcaccctgcccccgctccgctaccgcggggaggacggctgctggtacgggatggagatccgccccctgaaggagaaggaggagaacctggtgaacagcctcgtgaccgccggccacgggcaggtcgacaacttctccctgggcgtgctgggcatggccctgttcctggaggagatgctgcggacccgcgtggggacgaagcacgccatcctcctggtcgccgccagcttcgtgaccctgatcaccggcaacatgtccttcaaggacctcgggcgggtggtcgtgatggtgggcgccaccatgacggacgacatcgggatgggcgtcacctacctggcgctgctcgccgccttcaaggtgcgccccaccttcgccgccggcctgctgctccggaagctgaccagcaaggagctgatgatgacgaccatcgggatcgtgctcctgtcccagagcaccatccccgagaccatcctggagctcacggacgcgctggccctgggcatgatggtcctcaagatcgtgcgcaacatggagaagtaccagctggccgtgaccatcatggccatcctgtgcgtcccgaacgccgtgatcctccagaacgcgtggaaggtctcctgcaccatcctggccgtggtgagcgtcagccccctgctcctgaccagctcccagcagaagacggactggatccccctggccctcaccatcaaggggctgaaccccaccgccatcttcctgaccacgctcagccgcaccaacaagaagcggtcctggccgctgaacgaggcgatcatggccgtgggcatggtgagcatcctggcctccagcctcctgaagaacgacatccccatgaccggccccctggtcgccgggggcctcctgaccgtgtgctacgtgctgacggggcgctccgccgacctcgagctggagcgggcgaccgacgtcaagtgggaggaccaggccgagatcagcggcagctcccccatcctgagcatcaccatctccgaggacgggagcatgtccatcaagaacgaggaggaggagcagaccctcacgatcctgatccgcaccggcctgctcgtgatcagcggcctgttcccggtgtccatccccatcaccgccgccgcctggtacctgtgggaggtcaagaagcagcgggcgggggtgctctgggacgtgccctccccgccgcccatgggcaaggccgagctggaggacggggcctaccgcatcaagcagaagggcatcctggggtactcccagatcggcgccggcgtctacaaggaggggaccttccacaccatgtggcacgtgacgcggggcgccgtgctcatgcacaaggggaagcgcatcgagcccagctgggcggacgtcaagaaggacctgatctcctacggcgggggctggaagctggagggcgagtggaaggagggggaggaggtccaggtgctcgccctggagcccggcaagaacccccgggccgtccagaccaagcccgggctgttcaagaccaacaccggcacgatcggggccgtgagcctcgacttctcccccggcaccagcggctcccccatcatcgacaagaaggggaaggtggtcggcctgtacgggaacggcgtggtgacccgcagcggcgcctacgtctccgcgatcgcccagaccgagaagtccatcgaggacaaccccgagatcgaggacgacatcttccggaagcgccggctgacgatcatggacctgcaccccggggccggcaagaccaagcgctacctccccgccatcgtgcgggaggcgatcaagcgcgggctgcggaccctgatcctcgccccgacccgcgtggtcgccgccgagatggaggaggccctgcggggcctgcccatccgctaccagacgcccgcgatccgggccgagcacaccgggcgcgagatcgtggacctcatgtgccacgccaccttcaccatgcgcctgctgtcccccgtgcgggtcccgaactacaacctcatcatcatggacgaggcccacttcacggaccccgccagcatcgcggcccgcggctacatcagcacccgggtggagatgggcgaggccgccgggatcttcatgaccgccacgccgcccggctcccgcgacccgttcccccagagcaacgcgcccatcatcgacgaggagcgggagatccccgagcgctcctggaacagcgggcacgagtgggtgacggacttcaagggcaagaccgtctggttcgtgccgtccatcaaggccgggaacgacatcgccgcctgcctgcggaagaacggcaagaaggtgatccagctgagccgcaagaccttcgactccgagtacgtcaagacccggacgaacgactgggacttcgtggtgaccaccgacatcagcgagatgggcgcgaacttcaaggccgagcgcgtcatcgacccccggcgctgcatgaagcccgtgatcctcaccgacggggaggagcgggtgatcctggccggccccatgccggtcacgcactccagcgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgtccatgttcgagcccgagcgcgagaaggtggacgccatcgacggcgagtaccggctgcgcggggaggcccgcaagaccttcgtggacctcatgcggcgcggcgacctgcccgtctggctggcctacaaggtggcggccgaggggatcaactacgccgaccggcgctggtgcttcgacggcatcaagaacaaccagatcctcgaggagaacgtggaggtcgagatctggaccaaggagggggagcggaagaagctgaagccgcgctggctggacgcccggatctacagcgaccccctcgccctgaaggagttcaaggagttcgcggccggccgcaagtccctgacgctcaacctgatcaccgagatgggccggctgcccaccttcatgacccagaagacgcgcgacgccctcgacaacctggccgtgctgcacaccgcggaggccgggggccgggcctacaaccacgccctcagcgagctgcccgagaccctggagaccctcctgctgctcacgctgctggccaccgtcaccgggggcatcttcctcttcctgatgtccggccgcgggatcggcaagatgaccctggggatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacctacgtggtcatcgccatcctgaccgtggtggcggccaccatggccaacgagatgggcttcctggagaagacgaagaaggacctcgggctgggcagcatcgccacccagcagccggagtccaacatcctggacatcgacctccgccccgccagcgcgtggaccctgtacgccgtcgccaccacgttcgtgacccccatgctgcggcacagcatcgagaactccagcgtgaacgtctccctcaccgccatcgccaaccaggcgaccgtgctgatgggcctggggaagggctggcccctcagcaagatggacatcggggtgccgctgctggccatcggctgctactcccaggtcaaccccatcacgctcaccgccgccctgctgctcctggtggcgcactacgccatcatcgggcccggcctgcaggccaaggccacccgcgaggcccagaagcgggcggccgccggcatcatgaagaaccccaccgtggacgggatcacggtcatcgacctcgacccgatcccctacgaccccaagttcgagaagcagctgggccaggtgatgctgctcatcctgtgcgtgacccaggtcctgatgatgcgcaccacctgggccctctgcgaggccctgacgctggcgaccgggcccatcagcaccctctgggagggcaacccggggcggttctggaacaccacgatcgccgtgtccatggccaacatcttccgcggcagctacctggccggcgccgggctcctcttctccatcatgaagaacaccaccaacacccggcgcggcacggggaacatcggcgagaccctgggcgagaagtggaagtcccgcctgaacgcgctcgggaagtccgagttccagatctacaagaagtccggcatccaggaggtggaccggaccctggccaaggaggggatcaagcgcggcgagaccgaccaccacgccgtctcccgggggagcgccaagctgcgctggttcgtggagcggaacatggtgacgcccgagggcaaggtcgtggacctcggctgcgggcgcggcgggtggtcctactactgcggcgggctgaagaacgtgcgggaggtcaagggcctgaccaagggcgggcccggccacgaggagcccatcccgatgagcacctacgggtggaacctcgtgcgcctgcagtccggcgtggacgtcttcttcatcccgcccgagaagtgcgacaccctgctctgcgacatcggggagagctcccccaacccgacggtggaggcgggccggaccctgcgcgtgctgaacctcgtcgagaactggctgaacaacaacacccagttctgcatcaaggtgctgaacccctacatgcccagcgtgatcgagaagatggaggccctgcagcggaagtacggcggggccctcgtccgcaacccgctgagccggaactccacccacgagatgtactgggtgagcaacgcctccggcaacatcgtgagctccgtcaacatgatcagccgcatgctgatcaaccggttcaccatgcgccacaagaaggccacgtacgagcccgacgtggacctcgggtccggcacccggaacatcgggatcgagagcgagatccccaacctggacatcatcggcaagcgcatcgagaagatcaagcaggagcacgagacctcctggcactacgaccaggaccacccctacaagacctgggcgtaccacggcagctacgagacgaagcagaccgggtccgccagctccatggtgaacggcgtcgtgcggctgctcaccaagccgtgggacgtgctgcccaccgtcacgcagatggccatgaccgacaccacccccttcgggcagcagcgcgtgttcaaggagaaggtggacacgcgcacccaggagcccaaggagggcaccaagaagctgatgaagatcaccgccgagtggctctggaaggagctgggcaagaagaagacgccgcggatgtgcacccgcgaggagttcacccggaaggtccgcagcaacgccgcgctgggggccatcttcaccgacgagaacaagtggaagtccgcccgggaggccgtggaggacagccgcttctgggagctcgtggacaaggagcggaacctgcacctggagggcaagtgcgagacgtgcgtctacaacatgatggggaagcgcgagaagaagctcggcgagttcgggaaggccaagggctcccgggcgatctggtacatgtggctgggcgcccgcttcctggagttcgaggccctcgggttcctgaacgaggaccactggttcagccgggagaactccctgagcggcgtggagggggagggcctccacaagctggggtacatcctgcgcgacgtcagcaagaaggagggcggcgccatgtacgcggacgacaccgccgggtgggacacccggatcaccctcgaggacctgaagaacgaggagatggtgacgaaccacatggagggcgagcacaagaagctggccgaggccatcttcaagctcacctaccagaacaaggtggtccgcgtgcagcggcccacgccccgggggaccgtgatggacatcatctcccggcgcgaccagcggggcagcgggcaggtcggcacgtacggcctgaacaccttcaccaacatggaggcccagctgatccgccagatggagggggagggcgtgttcaagaacatccagcacctcaccgtgacggaggagatcgcggtccagaactggctggcccgggtggggcgcgagcgcctgtcccggatggccatcagcggcgacgactgcgtggtcaagcccctcgacgaccgcttcgccaacgccctgaccgcgctgaacgacatgggcaagatccggaaggacatccagcagtgggagccgtccaaggggtggaacgactggacccaggtgcccttctgcagccaccacttccacgagctcatcatgaaggacggccgcgtgctggtcgtgccctgccggaaccaggacgagctgatcgggcgcgcccggatctcccagggcgccgggtggagcctccgcgagaccgcctgcctgggcaagtcctacgcccagatgtggagcctgatgtacttccaccggcgcgacctccggctggcggccaacgccatctgctccgccgtgcccagccactgggtcccgacgtcccgcaccacctggagcatccacgccaagcacgagtggatgaccaccgaggacatgctgacggtgtggaaccgggtgtggatccaggagaacccctggatggaggacaagacccccgtcgagtcctgggaggagatcccctacctcggcaagcgcgaggaccagtggtgcgggagcctgatcggcctgacctcccgggcgacctgggccaagaacatccaggccgccatcaaccaggtgcgcagcctcatcgggaacgaggagtacacggactacatgccgagcatgaagcggttccgccgggaggaggaggaggcgggcgtgctgtggtga

SEQ ID NO: 9347 - RNA, 9876 nt, synthetic construct
  misc_feature 1..9876: note = derived and/or modified CDS sequence (opt1) from DENV-2__FJ906958__SS-prME
  source 1..9876: mol_type = other RNA
agcgtgggcatgatcatcatgctgatccccaccgtgatggcgttccacctcaccacccggaacggggagccccacatgatcgtgagcatccaggagaagggcaagagcctgctgttcaagaccgaggacggggtgaacatgtgcaccctcatggccatggacctgggcgagctgtgcgaggacaccatcacctacaagtgccccctcctgcggcagaacgagcccgaggacatcgactgctggtgcaacagcaccagcacctgggtcacctacgggacctgcaccaccaccggcgagcaccgccgggagaagcgctccgtggcgctggtgccccacgtcggcatggggctcgagacgcggaccgagacctggatgagctccgagggcgcctggaagcacgcccagcgcatcgagacctggatcctgcggcacccggggttcacgatcatggccgccatcctggcgtacaccatcggcaccacccacttccagcgcgccctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggcgaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtgtgcaagcactccatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagcacgcggtggggaacgacacgggcaagcacgggaaggagatcaaggtgaccccgcagtccagcatcaccgaggccgagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacacccaggggagcaactggatccagaaggagaccctggtcacgttcaagaacccccacgccaagaagcaggacgtggtcgtgctcggcagccaggagggggcgatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtcaaggagatcgccgagacccagcacggcaccatcgtgatccgggtgcagtacgagggggacggctccccctgcaaggtccccttcgagatcatggacctggagaagcgctacgtgctcggccggctgatcacggtgaacccggtcgtgaccgagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcgcggcgcgaagcgcatggccatcctgggcgacacggcctgggacttcgggagcctgggcggggtgttcacctccatcggcaaggccctccaccaggtgttcggggccatctacggcgcggccttcagcggcgtctcctggaccatgaagatcctgatcggggtgatcatcacctggatcggcatgaacagccggtccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcctccgcgatccagaaggcccaggaggaggggatctgcggcatccgcagcgtgacccggctggagaacctcatgtggaagcagatcacccccgagctgaaccacatcctggccgagaacgaggtcaagctcaccatcatgacgggggacatcaagggcatcatgcaggccgggaagcgctccctgcggccgcagcccaccgagctgaagtacagctggaagacctggggcaaggccaagatgctctccaccgagagccacaaccagacgttcctgatcgacggccccgagaccgcggagtgcccgaacaccaaccgcgcctggaactccctggaggtggaggactacgggttcggcgtgttcaccacgaacatctggctcaagctgaaggagaagcaggacgccttctgcgacagcaagctgatgtccgccgccgtcaaggacaaccgggcggtgcacgccgacatggggtactggatcgagagcgccctcaacgacacctggaagatcgagaaggcctccttcatcgaggtgaagaactgccactggcccaagagccacaccctgtggtccaacggcgtcctggagagcgagatgatcatccccaagaacctcgccggccccgtgtcccagcacaactaccgcccggggtaccacacccagatcgcgggcccctggcacctggggaagctggagatggacttcgacttctgcgacggcaccacggtggtcgtgaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtcaccgccggccagggccaggtggacaacttctccctgggcgtgctgggcatggccctcttcctggaggagatgctgcggacgcgcgtcgggaccaagcacgcgatcctcctggtggccgtgagcttcgtcaccctgatcaccggcaacatgtccttcaaggacctcgggcgggtggtggtcatggtgggcgccacgatgaccgacgacatcgggatgggcgtgacctacctggccctgctcgccgcgttcaaggtccgccccaccttcgccgccggcctgctgctccggaagctgacgagcaaggagctgatgatgaccaccatcgggatcgtgctcctgtcccagagcaccatccccgagacgatcctggagctcaccgacgccctggccctgggcatgatggtcctcaagatcgtgcgcgacatggagaagtaccagctggcggtgaccatcatggccatcctgtgcgtcccgaacgccgtgatcctccagaacgcctggaaggtgtcctgcaccatcctggccgtcgtgagcgtgagccccctgctcctgacgagctcccagcagaagaccgactggatccccctggcgctcaccatcaaggggctgaaccccaccgccatcttcctgacgaccctcagccgcaccaacaagaagcggtcctggccgctgaacgaggccatcatggccgtcggcatggtgagcatcctggcgtccagcctcctgaagaacgacatccccatgaccggccccctggtggccgggggcctcctgacggtctgctacgtgctgaccgggcgctccgccgacctcgagctggagcgggccaccgacgtgaagtgggaggaccaggccgagatcagcggcagctcccccatcctgagcatcaccatctccgaggacgggagcatgtccatcaagaacgaggaggaggagcagacgctcaccatcctgatccgcaccggcctgctcgtcatcagcggcctgttcccggtgtccatccccatcaccgcggccgcctggtacctgtgggaggtgaagaagcagcgggccggggtcctctgggacgtgccctccccgccgcccatgggcaaggccgagctggaggacggggcgtaccgcatcaagcagaagggcatcctggggtactcccagatcggcgccggcgtgtacaaggaggggaccttccacacgatgtggcacgtcacccggggcgccgtgctcatgcacaaggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagaccaagcccgggctgttcaagaccaacacgggcaccatcggggccgtcagcctcgacttctcccccggcaccagcggctcccccatcatcgacaagaaggggaaggtggtgggcctgtacgggaacggcgtcgtgacccgcagcggcgcctacgtgtccgccatcgcccagacggagaagtccatcgaggacaaccccgacatcgaggacgacatcttccggaagcgccggctgaccatcatggacctgcaccccggggcgggcaagaccaagcgctacctccccgccatcgtccgggaggccatcaagcgcgggctgcggaccctgatcctcgccccgacgcgcgtggtggcggccgagatggaggaggccctgcggggcctgcccatccgctaccagacccccgccatccgggccgagcacaccgggcgcgagatcgtcgacctcatgtgccacgcgaccttcacgatgcgcctgctgtcccccgtgcgggtgccgaactacaacctcatcatcatggacgaggcccacttcaccgaccccgccagcatcgccgcccgcggctacatcagcacccgggtcgagatgggcgaggcggccgggatcttcatgaccgccacgccgcccggctcccgcgacccgttcccccagagcaacgcccccatcatcgacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagaccttcgactccgagtacgccaagacgcggaccaacgactgggacttcgtggtcaccaccgacatcagcgagatgggcgccaacttcaaggcggagcgcgtgatcgacccccggcgctgcatgaagcccgtgatcctcacggacggggaggagcgggtcatcctggccggccccatgccggtgacccactccagcgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtcgccgcggaggggatcaactacgccgaccggcgctggtgcttcgacggcatcaagaacaaccagatcctcgaggagaacgtggaggtggagatctggacgaaggagggggagcggaagaagctgaagccgcgctggctggacgcccggatctacagcgaccccctcgccctgaaggagttcaaggagttcgccgcgggccgcaagtccctgaccctcaacctgatcaccgagatgggccggctgcccaccttcatgacgcagaagacccgcgacgccctcgacaacctggccgtcctgcacaccgccgaggccggcgggcgggcctacaaccacgccctcagcgagctgcccgagaccctggagacgctcctgctgctcaccctgctggccaccgtgaccggcgggatcttcctcttcctgatgtccgggcgcgggatcggcaagatgaccctggggatgtgctgcatcgtgacggccagcatcctcctgtggtacgcgcagatccagccgcactggatcgccgcctccatcatcctggagttcttcctcatcgtcctgctgatccccgagcccgagaagcagcggacgccccaggacaaccagctcacctacgtggtgatcgccatcctgaccgtcgtggccgcgacgatggccaacgagatgggcttcctggagaagaccaagaaggacctcgggctgggcagcatcgccacccagcagccggagtccaacatcctggacatcgacctccgccccgccagcgcctggaccctgtacgcggtggccacgaccttcgtcacccccatgctgcggcacagcatcgagaactccagcgtgaacgtgtccctcaccgccatcgccaaccaggccacggtcctgatgggcctggggaagggctggcccctcagcaagatggacatcggggtgccgctgctggcgatcggctgctactcccaggtgaaccccatcaccctcaccgccgccctgctgctcctggtcgcccactacgcgatcatcgggcccggcctgcaggccaaggccacccgcgaggcccagaagcgggccgcggccggcatcatgaagaaccccacggtggacgggatcaccgtgatcgacctcgacccgatcccctacgaccccaagttcgagaagcagctgggccaggtcatgctgctcgtgctgtgcgtgacccaggtcctgatgatgcgcaccacgtgggccctctgcgaggccctgaccctggccaccgggcccatcagcaccctctgggagggcaacccggggcggttctggaacacgaccatcgcggtgtccatggccaacatcttccgcggcagctacctggccggcgccgggctcctgttctccatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtggaccggaccctggcgaaggaggggatcaagcgcggcgagacggaccaccacgccgtctcccgggggagcgccaagctgcgctggttcgtggagcggaacatggtgacccccgagggcaaggtcgtggacctcggctgcgggcgcggcgggtggtcctactactgcggcgggctgaagaacgtgcgggaggtcaagggcctgaccaagggcgggcccggccacgaggagcccatcccgatgagcacctacgggtggaacctcgtgcgcctgcagtccggcgtggacgtcttcttcatcccgcccgagaagtgcgacacgctgctctgcgacatcggggagagctcccccaacccgaccgtggaggccggccggaccctgcgcgtgctgaacctcgtcgagaactggctgaacaacaacacccagttctgcatcaaggtgctgaacccctacatgcccagcgtgatcgagaagatggagaccctgcagcggaagtacggcggggcgctcgtccgcaacccgctgagccggaactccacgcacgagatgtactgggtgagcaacgcctccggcaacatcgtgagctccgtcaacatgatcagccgcatgctgatcaaccggttcaccatgcgccacaagaaggccacctacgagcccgacgtggacctcgggtccggcacccggaacatcgggatcgagagcgagatccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtgaacggcgtcgtgcggctgctcacgaagccgtgggacgtgctgcccaccgtcacccagatggcgatgaccgacacgacccccttcgggcagcagcgcgtgttcaaggagaaggtcgacacccgcacccaggagcccaaggagggcacgaagaagctgatgaagatcaccgccgagtggctctggaaggagctgggcaagaagaagaccccgcggatgtgcacccgcgaggagttcacgcggaaggtgcgcagcaacgccgccctgggggccatcttcaccgacgagaacaagtggaagtccgcgcgggaggccgtggaggacagccgcttctgggagctcgtcgacaaggagcggaacctgcacctggagggcaagtgcgagacctgcgtgtacaacatgatggggaagcgcgagaagaagctcggcgagttcgggaaggccaagggctcccgggccatctggtacatgtggctgggcgcccgcttcctggagttcgaggcgctcgggttcctgaacgaggaccactggttcagccgggagaactccctgagcggcgtggagggggagggcctccacaagctggggtacatcctgcgcgacgtcagcaagaaggagggcggcgccatgtacgccgacgacaccgccgggtgggacacgcggatcaccctcgaggacctgaagaacgaggagatggtgaccaaccacatggagggcgagcacaagcgcctggcggaggccatcttcaagctcacctaccagaacaaggtggtccgggtgcagcgccccacgccccgggggaccgtgatggacatcatctcccgccgggaccagcgcggcagcgggcaggtcggcacctacggcctgaacaccttcacgaacatggaggcccagctgatccggcagatggagggggagggcgtgttcaagaacatccagcacctcaccgtgaccgaggagatcgccgtccagaactggctggcccgcgtggggcgcgagcggctgtcccgcatggcgatcagcggcgacgactgcgtggtcaagcccctcgacgaccggttcgcctccgccctgaccgccctgaacgacatgggcaagatccgcaaggacatccagcagtgggagccgagccgggggtggaacgactggacgcaggtccccttctgctcccaccacttccacgagctcatcatgaaggacggccgcgtgctggtcgtgccctgccggaaccaggacgagctgatcgggcgcgcccggatcagccagggcgcggggtggtccctccgcgagaccgcctgcctgggcaagagctacgcccagatgtggtccctgatgtacttccaccggcgcgacctccggctggccgccaacgcgatctgcagcgccgtgccctcccactgggtcccgaccagccgcaccacctggtccatccacgccaagcacgagtggatgacgaccgaggacatgctgaccgtgtggaaccgggtgtggatccaggagaacccctggatggaggacaagacccccgtcgagagctgggaggagatcccctacctcggcaagcgcgaggaccagtggtgcgggtccctgatcggcctgacgagccgggccacctgggccaagaacatccaggcggccatcaaccaggtgcgcagcctcatcgggaacgaggagtacaccgactacatgccgtccatgaagcggttccgccgcgaggaggaggaggccggcgtgctgtggtga

SEQ ID NO: 9348 - RNA, 9876 nt, synthetic construct
  misc_feature 1..9876: note = derived and/or modified CDS sequence (opt1) from DENV-2__FJ898452__SS-prME
  source 1..9876: mol_type = other RNA
agcgcgggcatgatcatcatgctgatccccaccgtgatggccttccacctcaccacccgcaacggggagccccacatgatcgtcggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgtcctcatcttcatcctgctgacggccgtggccccctccatgaccatgcggtgcatcggcatcagcaaccgcgacttcgtggagggcgtctccgggggcagctgggtggacatcgtgctcgagcacgggtcctgcgtcaccaccatggcgaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtgtgcaagcacagcatggtggaccgcggctgggggaacggctgcggcctgttcggcaagggcgggatcgtcacgtgcgccatgttcacgtgcaagaagaacatggagggcaagatcgtgcagcccgagaacctggagtacaccatcgtggtcacgccccactccggggaggagcacgcggtgggcaacgacacggggaagcacggcaaggagatcaaggtgaccccgcagagctccatcaccgaggccgagctgaccgggtacggcaccgtcacgatggagtgcagcccccggaccggcctcgacttcaacgagatggtgctgctgcagatggagaacaaggcctggctcgtgcaccgccagtggttcctggacctgcccctcccctggctgccgggggccgacaagcaggagtccaactggatccagaaggagaccctggtcaccttcaagaacccccacgccaagaagcaggacgtggtcgtgctcggcagccaggagggggcgatgcacacggccctgaccggcgccaccgagatccagatgagctccgggaacctcctgttcaccggccacctgaagtgccggctgcgcatggacaagctccagctgaagggcatgagctactccatgtgcacggggaagttcaaggtggtcaaggagatcgccgagacccagcacggcaccatcgtgatccgggtgcagtacgagggggacggcagcccctgcaagatccccttcgagatcatggacctggagaagcgctacgtcctcggccggctgatcaccgtgaacccgatcgtgacggagaaggactcccccgtcaacatcgaggccgagccgcccttcggggacagctacatcatcatcggcgtggagccggggcagctgaagctcaactggttcaagaagggctccagcatcgggcagatgttcgagaccaccatgcgcggcgcgaagcgcatggccatcctgggcgacaccgcctgggacttcgggtccctgggcggggtgttcacgagcatcggcaaggccctccaccaggtcttcggggccatctacggcgcggccttctccggcgtgagctggaccatgaagatcctgatcggggtgatcatcacctggatcggcatgaactcccggagcacctccctgagcgtctccctggtgctcgtggggatcgtcacgctgtacctgggcgtgatggtgcaggccgacagcgggtgcgtcgtgtcctggaagaacaaggagctcaagtgcggcagcggcatcttcatcaccgacaacgtgcacacctggaccgagcagtacaagttccagcccgagagcccctccaagctggccagcgcgatccagaaggcccaggaggaggggatctgcggcatccgctccgtcacgcggctggagaacctcatgtggaagcagatcacccccgagctgaaccacatcctggccgagaacgaggtgaagctcaccatcatgaccggggacatcaagggcatcatgcaggccgggaagcgcagcctgcggccgcagcccacggagctgaagtactcctggaagacctggggcaaggccaagatgctcagcaccgagtcctacaaccagaccttcctgatcgacggccccgagacggcggagtgcccgaacaccaaccgcgcctggaacagcctggaggtggaggactacgggttcggcgtcttcaccaccaacatctggctcaagctgaaggagaagcaggacgccttctgcgactccaagctgatgagcgccgccatcaaggacaaccgggcggtgcacgccgacatggggtactggatcgagtccgccctcaacgacacgtggaagatcgagaaggccagcttcatcgaggtgaagaactgccactggcccaagtcccacaccctgtggagcaacggcgtcctggagtccgagatgatcatccccaagaacctcgccggccccgtgagccagcacaactaccgcccggggtaccacacccagatcgcgggcccctggcacctggggaagctggagatggacttcgacttctgcgacggcaccaccgtgatcgtcacggaggactgcgggaaccggggcccctccctccgcaccaccaccgccagcggcaagctgatcacggagtggtgctgccggagctgcaccctgcccccgctccgctaccgcggggaggacggctgctggtacgggatggagatccgccccctgaaggagaaggaggagaacctggtgaactccctcgtgaccgccggccacgggcaggtcgacaacttcagcctgggcgtgctgggcatggccctcttcctggaggagatgctgcggacccgcgtggggacgaagcacgcgatcctcctggtcgccgtgtccttcgtgaccctgatcaccggcaacatgagcttcaaggacctcgggcgggtcgtggtgatggtcggcgccaccatggccgacgacatcgggatgggcgtgacgtacctggccctgctcgcggccttcaaggtgcgccccaccttcgccgccggcctgctgctccggaagctgacctccaaggagctgatgatgaccacgatcgggatcgtcctcctgagccagtccaccatccccgagaccgtgctggagctcaccgacgccctggcgctgggcatgatggtgctcaagatcgtccgcaacatggagaagtaccagctggccgtgacgatcatggccatcctgtgcgtcccgaacgccgtgatcctccagaacgcctggaaggtgagctgcaccatcctggcggtcgtgtccgtgagccccctgctcctgacctccagccagcagaagaccgactggatccccctggccctcacgatcaaggggctgaaccccaccgccatcttcctgaccaccctctcccgcacgaacaagaagcggagctggccgctgaacgaggccatcatggcggtcggcatggtgtccatcctggccagctccctcctgaagaacgacatccccatgaccggccccctggtggccgggggcctcctgaccgtctgctacgtgctgaccgggcgcagcgccgacctcgagctggagcgggccacggacgtgaagtgggaggaccaggcggagatctccggcagcagccccatcctgtccatcaccatcagcgaggacgggtccatgagcatcaagaacgaggaggaggagcagaccctcaccatcctgatccgcacgggcctgctcgtcatctccggcctgttcccgatcagcatccccatcaccgccgccgcctggtacctgtgggaggtgaagaagcagcgggccggggtgctctgggacgtccccagcccgccgcccatgggcaaggcggagctggaggacggggcctaccgcatcaagcagaagggcatcctggggtacagccagatcggcgccggcgtgtacaaggaggggaccttccacaccatgtggcacgtgacccggggcgccgtcctcatgcacaaggggaagcgcatcgagccctcctgggccgacgtgaagaaggacctgatcagctacggcgggggctggaagctggagggcgagtggaaggagggggaggaggtgcaggtcctcgcgctggagcccggcaagaacccccgggccgtgcagacgaagcccgggctgttcaagaccaacaccggcaccatcggggccgtgtccctcgacttcagccccggcacgtccggcagccccatcatcgacaagaaggggaaggtcgtgggcctgtacgggaacggcgtggtcacccgctccggcgcctacgtgagcgccatcgcgcagaccgagaagtccatcgaggacaaccccgagatcgaggacgacatcttccggaagcgccggctgaccatcatggacctgcaccccggggccggcaagacgaagcgctacctccccgccatcgtgcgggaggccatcaagcgcgggctgcggaccctgatcctcgcgccgacccgcgtcgtggccgccgagatggaggaggccctgcggggcctgcccatccgctaccagacccccgccatccgggcggagcacacggggcgcgagatcgtggacctcatgtgccacgccaccttcaccatgcgcctgctgagccccgtccgggtgccgaactacaacctcatcatcatggacgaggcccacttcaccgaccccgcctccatcgccgcgcgcggctacatcagcacgcgggtggagatgggcgaggccgccgggatcttcatgaccgccacgccgcccggcagccgcgacccgttcccccagtccaacgcccccatcatcgacgaggagcgggagatccccgagcgcagctggaactccgggcacgagtgggtcaccgacttcaagggcaagacggtgtggttcgtgccgagcatcaaggcggggaacgacatcgccgcctgcctgcggaagaacggcaagaaggtcatccagctgtcccgcaagaccttcgacagcgagtacgtgaagacccggaccaacgactgggacttcgtggtcacgaccgacatctccgagatgggcgccaacttcaaggcggagcgcgtgatcgacccccggcgctgcatgaagcccgtgatcctcaccgacggggaggagcgggtcatcctggccggccccatgccggtgacccacagctccgccgcccagcgccgggggcgcatcggccggaaccccaagaacgagaacgaccagtacatctacatgggggagcccctggagaacgacgaggactgcgcccactggaaggaggcgaagatgctcctggacaacatcaacacgcccgagggcatcatcccgagcatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggaccaaggagggggagcggaagaagctgaagccgcgctggctggacgcccggatctactccgaccccctcgccctgaaggagttcaaggagttcgccgcgggccgcaagagcctgaccctcaacctgatcacggagatgggccggctgcccaccttcatgacccagaagacccgcgacgccctcgacaacctggccgtcctgcacacggccgaggccggcgggcgggcctacaaccacgccctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacgtacgtcgtgatcgccatcctgaccgtggtcgccgcgaccatggccaacgagatgggcttcctggagaagaccaagaaggacctcgggctgggctccatcgccacgcagcagccggagagcaacatcctggacatcgacctccgccccgcctccgcctggaccctgtacgcggtggccaccaccttcgtgacgcccatgctgcggcacagcatcgagaacagctccgtcaacgtgagcctcaccgccatcgccaaccaggccaccgtgctgatgggcctggggaagggctggcccctctccaagatggacatcggggtcccgctgctggcgatcggctgctacagccaggtgaaccccatcaccctcacggccgccctgctgctcctggtggcccactacgcgatcatcgggcccggcctgcaggccaaggccacccgcgaggcccagaagcgggccgcggccggcatcatgaagaaccccaccgtcgacgggatcaccgtgatcgacctcgacccgatcccctacgaccccaagttcgagaagcagctgggccaggtgatgctgctcatcctgtgcgtcacccaggtgctgatgatgcgcaccacctgggccctctgcgaggccctgaccctggccacggggcccatctccaccctctgggagggcaacccggggcggttctggaacaccaccatcgcggtgagcatggccaacatcttccgcggctcctacctggccggcgccgggctcctcttcagcatcatgaagaacacgaccaacacccggcgcggcaccgggaacatcggcgagacgctgggcgagaagtggaagtcccgcctgaacgccctcgggaagtccgagttccagatctacaagaagtccggcatccaggaggtcgaccggaccctggcgaaggaggggatcaagcgcggcgagaccgaccaccacgccgtgagccgggggtccgccaagctgcgctggttcgtggagcggaacatggtcacccccgagggcaaggtggtggacctcggctgcgggcgcggcgggtggagctactactgcggcgggctgaagaacgtccgggaggtgaagggcctgacgaagggcgggcccggccacgaggagcccatcccgatgtccacctacgggtggaacctcgtgcgcctgcagagcggcgtcgacgtgttcttcatcccgcccgagaagtgcgacaccctgctctgcgacatcggggagtccagccccaacccgaccgtggaggccggccggacgctgcgcgtcctgaacctcgtggagaactggctgaacaacaacacccagttctgcatcaaggtgctgaacccctacatgccctccgtcatcgagaagatggaggcgctgcagcggaagtacggcggggccctcgtgcgcaacccgctgagccggaacagcacccacgagatgtactgggtgtccaacgccagcggcaacatcgtctccagcgtgaacatgatctcccgcatgctgatcaaccggttcaccatgcgccacaagaaggccacctacgagcccgacgtggacctcgggagcggcacgcggaacatcgggatcgagtccgagatccccaacctggacatcatcggcaagcgcatcgagaagatcaagcaggagcacgagaccagctggcactacgaccaggaccacccctacaagacctgggcctaccacggctcctacgagaccaagcagacggggagcgcgtccagcatggtcaacggcgtggtgcggctgctcaccaagccgtgggacgtcctgcccaccgtgacccagatggccatgacggacaccacccccttcgggcagcagcgcgtgttcaaggagaaggtcgacacccgcacgcaggagcccaaggagggcaccaagaagctgatgaagatcaccgccgagtggctctggaaggagctgggcaagaagaagaccccgcggatgtgcacgcgcgaggagttcacccggaaggtgcgctccaacgccgccctgggggcgatcttcaccgacgagaacaagtggaagtccgcccgggaggccgtggaggactcccgcttctgggagctcgtcgacaaggagcggaacctgcacctggagggcaagtgcgagacctgcgtgtacaacatgatggggaagcgcgagaagaagctcggcgagttcgggaaggccaagggcagccgggccatctggtacatgtggctgggcgcgcgcttcctggagttcgaggccctcgggttcctgaacgaggaccactggttctcccgggagaacagcctgtccggcgtcgagggggagggcctccacaagctggggtacatcctgcgcgacgtgagcaagaaggagggcggcgccatgtacgccgacgacacggcggggtgggacacccggatcaccctcgaggacctgaagaacgaggagatggtgaccaaccacatggagggcgagcacaagaagctggccgaggccatcttcaagctcacgtaccagaacaaggtcgtgcgcgtgcagcggcccacgccccgggggaccgtcatggacatcatcagccggcgcgaccagcggggctccggccaggtggggacctacggcctgaacacgttcaccaacatggaggcccagctgatccgccagatggagggggagggcgtgttcaagaacatccagcacctcaccgtcaccgaggaggtggccgtgcagaactggctggcgcgggtcgggcgcgagcgcctgagccggatggccatctccggcgacgactgcgtggtgaagcccctcgacgaccgcttcgccaacgccctgacggccctgaacgacatgggcaagatccggaaggacatccagcagtgggagccgagcaaggggtggaacgactggacccaggtccccttctgctcccaccacttccacgagctcatcatgaaggacggccgcgtgctggtggtcccctgccggaaccaggacgagctgatcgggcgcgcgcggatcagccagggcgccgggtggtccctccgcgagaccgcctgcctgggcaagagctacgcccagatgtggtccctgatgtacttccaccggcgcgacctccggctggccgcgaacgccatctgcagcgccgtgccctcccactgggtgccgaccagccgcacgacctggtccatccacgccaagcacgagtggatgaccaccgaggacatgctgaccgtctggaaccgggtgtggatccgcgagaacccctggatggaggacaagacgcccgtggagagctgggaggagatcccctacctcggcaagcgggaggaccagtggtgcgggtccctgatcggcctgaccagccgcgccacctgggcgaagaacatccaggccgccatcaaccaggtccggtccctcatcgggaacgaggagtacaccgactacatgccgagcatgaagcgcttccggcgcgaggaggaggaggccggcgtgctgtggtga

SEQ ID NO: 9349 - RNA, 9876 nt, synthetic construct
  misc_feature 1..9876: note = derived and/or modified CDS sequence (opt1) from DENV-2__GQ868591__SS-prME
  source 1..9876: mol_type = other RNA
tccgccgggatgatcatcatgctgatccccaccgtgatggccttccacctcaccacccgcaacggggagccccacatgatcgtctcccggcaggagaagggcaagagcctgctgttcaagaccgaggacggggtgaacatgtgcaccctcatggcgatggacctgggcgagctgtgcgaggacaccatcacctacaagtgccccctcctgcgccagaacgagcccgaggacatcgactgctggtgcaactccaccagcacctgggtgacctacgggacctgcaccaccatgggcgagcaccggcgcgagaagcggtccgtcgccctggtgccccacgtgggcatggggctcgagacccgcaccgagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgccccacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcacgccccacagcggcgaggagcacgccgtggggaacgacaccggcaagcacgggaaggagatcaagatcacgccgcagtccagcatcaccgaggcggagctgaccggctacgggaccgtgaccatggagtgcagcccccggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctcctgttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaacccgatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctccaccaggtgttcggggccatctacggcgccgcgttcagcggcgtctcctggaccatgaagatcctgatcggggtgatcatcacctggatcggcatgaacagccggtccaccagcctgtccgtgacgctggtcctcgtggggatcgtgaccctgtacctgggcgtcatggtgcaggccgacagcgggtgcgtggtctcctggaagaacaaggagctcaagtgcggcagcggcatcttcatcaccgacaacgtgcacacctggacggagcagtacaagttccagcccgagagcccctccaagctggccagcgccatccagaaggcgcacgaggaggggatctgcggcatccgctccgtgacccggctggagaacctcatgtggaagcagatcacccccgagctgaaccacatcctgagcgagaacgaggtcaagctcaccatcatgacgggggacatcaagggcatcatgcaggccgggaagcgctccctgcggccgcagcccaccgagctgaagtacagctggaagacctggggcaaggccaagatgctctccaccgagagccacaaccagacgttcctgatcgacggccccgagaccgccgagtgcccgaacaccaaccgcgcctggaactccctggaggtggaggactacgggttcggcgtgttcaccacgaacatctggctcaagctgaaggagaagcaggacgtcttctgcgacagcaagctgatgtccgcggccatcaaggacaaccgggccgtgcacgccgacatggggtactggatcgagagcgccctcaacgacacctggaagatcgagaaggcgtccttcatcgaggtgaagaactgccactggcccaagagccacaccctgtggtccaacggcgtcctggagagcgagatgatcatccccaagaacctcgccggccccgtgtcccagcacaactaccgcccggggtaccacacccagatcaccggcccctggcacctggggaagctggagatggacttcgacttctgcgacggcacgaccgtggtcgtgaccgaggactgcgggaaccggggccccagcctccgcaccacgaccgccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtcacggccggccacggccaggtggacaacttctccctgggcgtgctgggcatggccctcttcctggaggagatgctgcggacccgcgtcgggaccaagcacgcgatcctcctggtggccgtgagcttcgtcaccctgatcacgggcaacatgtccttccgggacctcgggcgcgtgatggtgatggtcggcgccaccatgaccgacgacatcgggatgggcgtgacctacctggccctgctcgcggccttcaaggtgcgccccacgttcgccgccggcctgctgctccggaagctgaccagcaaggagctgatgatgaccaccatcgggatcgtcctcctgtcccagagcacgatccccgagaccatcctggagctcaccgacgccctggcgctgggcatgatggtgctcaagatggtgcgcaacatggagaagtaccagctggccgtcaccatcatggccatcctgtgcgtgccgaacgccgtcatcctccagaacgcctggaaggtgtcctgcacgatcctggcggtggtcagcgtgagccccctgctcctgaccagctcccagcagaagaccgactggatccccctggccctcaccatcaaggggctgaaccccacggccatcttcctgaccaccctcagccggacctccaagaagcgcagctggccgctgaacgaggccatcatggccgtgggcatggtctccatcctggcgagctccctcctgaagaacgacatccccatgacgggccccctggtggccgggggcctcctgaccgtgtgctacgtcctgaccgggcggagcgccgacctcgagctggagcgcgccgcggacgtgaagtgggaggaccaggccgagatcagcggctccagccccatcctgtccatcaccatcagcgaggacgggtccatgagcatcaagaacgaggaggaggagcagacgctcaccatcctgatccggaccggcctgctcgtgatctccggcctgttcccggtcagcatccccatcaccgccgccgcctggtacctgtgggaggtgaagaagcagcgcgcgggggtgctctgggacgtccccagcccgccgcccatgggcaaggccgagctggaggacggggcctaccggatcaagcagaagggcatcctggggtacagccagatcggcgccggcgtgtacaaggaggggaccttccacacgatgtggcacgtgacccgcggcgccgtcctcatgcacaaggggaagcggatcgagccctcctgggcggacgtgaagaaggacctgatcagctacggcgggggctggaagctggagggcgagtggaaggagggggaggaggtgcaggtcctcgccctggagcccggcaagaacccccgcgccgtgcagaccaagcccgggctgttcaagaccaacgccggcacgatcggggccgtgtccctcgacttcagccccggcacctccggcagccccatcatcgacaagaaggggaaggtcgtgggcctgtacgggaacggcgtggtcacccggtccggcgcgtacgtgagcgccatcgcccagaccgagaagtccatcgaggacaaccccgagatcgaggacgacatcttccgcaagcggcgcctgacgatcatggacctgcaccccggggccggcaagaccaagcggtacctccccgccatcgtgcgcgaggcgatcaagcgggggctgcgcaccctgatcctcgccccgacccgggtcgtggccgccgagatggaggaggcgctgcgcggcctgcccatccgctaccagacgcccgccatccgggccgagcacaccgggcgcgagatcgtggacctcatgtgccacgccaccttcaccatgcggctgctgagccccgtccgcgtgccgaactacaacctcatcatcatggacgaggcccacttcacggaccccgcgagcatcgccgcccggggctacatctccacccgcgtggagatgggcgaggccgccgggatcttcatgaccgcgacgccgcccggcagccgggacccgttcccccagtccaacgcccccatcatcgacgaggagcgcgagatccccgagcggagctggaactccgggcacgagtgggtcacggacttcaagggcaagaccgtgtggttcgtgccgagcatcaaggccgggaacgacatcgccgcctgcctgcgcaagaacggcaagaaggtcatccagctgtcccggaagaccttcgacagcgagtacgtgaagacccgcacgaacgactgggacttcgtggtcaccaccgacatctccgagatgggcgcgaacttcaaggccgagcgggtgatcgacccccgccggtgcatgaagcccgtgatcctcaccgacggggaggagcgcgtcatcctggccggccccatgccggtgacgcacagctccgccgcgcagcggcgcgggcggatcggccgcaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgccatcgacggcgagtaccggctgcgcggggaggcccggaagaccttcgtcgacctcatgcgccggggcgacctgcccgtgtggctggcgtaccgcgtggccgccgaggggatcaactacgccgaccggcgctggtgcttcgacggcgtcaagaacaaccagatcctcgaggagaacgtggaggtcgagatctggaccaaggagggggagcggaagaagctgaagccgcgctggctggacgcccggatctactccgaccccctcgcgctgaaggagttcaaggagttcgccgccggccgcaagagcctgacgctcaacctgatcaccgagatgggccggctgcccaccttcatgacccagaaggcccgcgacgccctcgacaacctggcggtgctgcacacggccgaggccgggggccgggcctacaaccacgcgctctccgagctgcccgagaccctggagaccctcctgctgctcaccctgctggccacggtgaccgggggcatcttcctcttcctgatgagcggccgcgggatcggcaagatgaccctggggatgtgctgcatcatcaccgcctccatcctcctgtggtacgcccagatccagccgcactggatcgccgcgagcatcatcctggagttcttcctcatcgtcctgctgatccccgagcccgagaagcagcggacgccccaggacaaccagctcacgtacgtggtgatcgccatcctgaccgtcgtggccgccaccatggccaacgagatgggcttcctggagaagaccaagaaggacctcgggctgggctccatcgcgacgcagcagccggagagcaacatcctggacatcgacctccgccccgccagcgcctggaccctgtacgccgtggccaccaccttcgtcacgcccatgctgcggcactccatcgagaacagctccgtgaacgtgagcctcaccgcgatcgccaaccaggccaccgtcctgatgggcctggggaagggctggcccctctccaagatggacatcggggtgccgctgctggccatcggctgctacagccaggtgaaccccatcaccctcacggccgcgctgttcctgctcgtcgcccactacgccatcatcgggcccggcctgcaggccaaggcgacccgcgaggcccagaagcgggccgccgccggcatcatgaagaaccccaccgtggacgggatcaccgtgatcgacctggacccgatcccctacgaccccaagttcgagaagcagctcggccaggtcatgctgctggtgctctgcgtgacgcaggtcctgatgatgcgcaccacctgggcgctgtgcgaggccctcaccctggccacggggcccatctccaccctgtgggagggcaacccggggcgcttctggaacaccaccatcgccgtgagcatggccaacatcttccggggctcctacctcgcgggcgccgggctgctgttcagcatcatgaagaacacgaccaacacccgccggggcaccgggaacatcggcgagacgctcggcgagaagtggaagtcccgcctgaacgccctggggaagtccgagttccagatctacaagaagtccggcatccaggaggtggaccggaccctcgccaaggaggggatcaagcgcggcgagaccgaccaccacgccgtcagccgggggtccgcgaagctgcgctggttcgtggagcggaacatggtgacccccgagggcaaggtcgtggacctgggctgcgggcgcggcgggtggagctactactgcggcgggctcaagaacgtgcgggaggtcaagggcctgacgaagggcgggcccggccacgaggagcccatcccgatgtccacctacgggtggaacctggtgcgcctccagagcggcgtggacgtcttcttcatcccgcccgagaagtgcgacaccctgctgtgcgacatcggggagtccagccccaacccgaccgtggaggccggccggacgctccgcgtgctgaacctggtcgagaactggctcaacaacaacacccagttctgcatcaaggtgctgaacccctacatgcccagcgtgatcgagaagatggaggccctgcagcggaagtacggcggggccctggtccgcaacccgctctcccggaacagcacccacgagatgtactgggtgtccaacgcgagcggcaacatcgtgtccagcgtcaacatgatctcccgcatgctgatcaaccggttcaccatgcgctacaagaaggccacctacgagcccgacgtggacctggggagcggcacgcgcaacatcgggatcgagtccgagatccccaacctcgacatcatcggcaagcggatcgagaagatcaagcaggagcacgagaccagctggcactacgaccaggaccacccctacaagacctgggcctaccacggctcctacgagaccaagcagacggggagcgcctccagcatggtgaacggcgtcgtgcgcctgctgaccaagccgtgggacgtggtccccatggtgacccagatggccatgaccgacacgacccccttcgggcagcagcgggtgttcaaggagaaggtcgacacccgcacccaggagcccaaggagggcacgaagaagctcatgaagatcaccgcggagtggctgtggaaggagctgggcaagaagaagaccccgcggatgtgcacccgcgaggagttcacgcggaaggtgcgctccaacgccgccctcggggccatcttcgccgacgagaacaagtggaagtccgcgcgggaggccgtcgaggactcccgcttctgggagctggtggacaaggagcggaacctgcacctcgagggcaagtgcgagacctgcgtgtacaacatgatggggaagcgcgagaagaagctgggcgagttcgggaaggccaagggcagccgggccatctggtacatgtggctgggcgcccgcttcctcgagttcgaggcgctggggttcctgaacgaggaccactggttctcccgggagaacagcctcagcggcgtcgagggggagggcctgcacaagctggggtacatcctccgcgacgtgtccaagaaggagggcggcgccatgtacgccgacgacaccgccgggtgggacacccggatcacgctggaggacctgaagaacgaggagatggtgaccaaccacatggagggcgagcacaagaagctcgcggaggccatcttcaagctgacctaccagaacaaggtcgtgcgcgtgcagcggcccacgccccgggggacggtcatggacatcatcagccggcgcgaccagcgcggctccggccaggtggggacctacggcctgaacaccttcaccaacatggaggcccagctcatccggcagatggagggggagggcgtgttcaagagcatccagcacctgacgatcaccgaggagatcgccgtccagaactggctggcccgcgtggggcgggagcgcctctcccggatggcgatcagcggcgacgactgcgtggtcaagcccctggacgaccgcttcgcctccgccctgaccgccctcaacgacatgggcaagatccggaaggacatccagcagtgggagccgagccgcgggtggaacgactggacccaggtgcccttctgctcccaccacttccacgagctgatcatgaaggacggccgggtgctggtcgtgccctgccgcaaccaggacgagctcatcgggcgggcccgcatcagccagggcgcggggtggtccctgcgggagacggcctgcctgggcaagagctacgcccagatgtggtccctcatgtacttccaccgccgggacctgcgcctggccgccaacgcgatctgcagcgccgtgccctcccactgggtcccgaccagccggaccacctggtccatccacgccaagcacgagtggatgacgaccgaggacatgctcaccgtgtggaaccgcgtgtggatccaggagaacccctggatggaggacaagacccccgtcgagagctgggaggagatcccctacctgggcaagcgggaggaccagtggtgcgggagcctgatcggcctcacctcccgcgccacgtgggccaagaacatccaggcggccatcaaccaggtgcgcagcctgatcgggaacgaggagtacaccgactacatgccgtccatgaagcggttccgccgggaggaggaggaggccggcgtgctgtggtga

SEQ ID NO: 9350 - RNA, 9876 nt, synthetic construct
  misc_feature 1..9876: note = derived and/or modified CDS sequence (opt1) from DENV-2__GQ868542__SS-prME
  source 1..9876: mol_type = other RNA
agcgcgggcatgatcatcatgctgatccccaccgtgatggcgttccacctcaccacccggaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaactccaccagcacctgggtgacctacgggacgtgcaccaccaccggcgagcaccgccgggagaagcgctccgtcgccctggtgccccacgtgggcatggggctcgagacgcggaccgagacctggatgagctccgagggcgcctggaagcacgcccagcgcatcgagacctggatcctgcggcacccggggttcacgatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatggtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcatcaccgaggccgagctgaccggctacgggaccgtgacgatggagtgcagcccccggaccggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgacgttcaagaacccccacgcgaagaagcaggacgtcgtggtcctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtgaaggagatcgccgagacccagcacggcaccatcgtcatccgggtgcagtacgagggggacggctccccctgcaagatccccttcgagatcatggacctggagaagcgctacgtgctcggccggctgatcacggtcaacccgatcgtgaccgagaaggacagccccgtgaacatcgaggcggagccgcccttcggggactcctacatcatcatcggcgtcgagccggggcagctgaagctcaactggttcaagaagggcagctccatcgggcagatgttcgagaccaccatgcgcggcgccaagcgcatggccatcctgggcgacacggcctgggacttcgggagcctgggcggggtgttcacctccatcggcaaggccctccaccaggtgttcggggcgatctacggcgccgccttcagcggcgtctcctggaccatgaagatcctgatcggggtgatcatcacctggatcggcatgaacagccggtccacgagcctgtccgtgagcctggtcctcgtggggatcgtgaccctgtacctgggcgtcatggtgcaggccgactccgggtgcgtggtcagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccgcagcgtgacccggctggagaacctcatgtggaagcagatcacccccgagctgaaccacatcctggccgagaacgaggtcaagctcaccatcatgacgggggacatcaagggcatcatgcaggccgggaagcgctccctgcggccgcagcccaccgagctgaagtacagctggaagacctggggcaaggcgaagatgctctccaccgagagccacaaccagacgttcctgatcgacggccccgagaccgccgagtgcccgaacaccaaccgcgcctggaactccctggaggtggaggactacgggttcggcgtgttcaccacgaacatctggctcaagctgaaggagaagcaggacgccttctgcgacagcaagctgatgtccgccgcgatcaaggacaaccgggccgtccacgccgacatggggtactggatcgagagcgccctcaacgacacctggaagatcgagaaggcctccttcatcgaggtgaagaactgccactggcccaagagccacaccctgtggtccaacggcgtgctggagagcgagatgatcatccccaagaacctcgcgggccccgtctcccagcacaactaccgcccggggtaccacacccagatcgccggcccctggcacctggggaagctggagatggacttcgacttctgcgacggcaccacggtggtggtcaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtgaccgccggccacgggcaggtcgacaacttctccctgggcgtgctgggcatggccctgttcctggaggagatgctgcggacgcgcgtggggaccaagcacgccatcctcctggtcgccgtgagcttcgtgaccctgatcaccggcaacatgtccttcaaggacctcgggcgggtcgtggtgatggtcggcgccacgatgaccgacgacatcgggatgggcgtgacctacctggccctgctcgcggccttcaaggtgcgccccaccttcgccgccggcctgctgctccggaagctgacgagcaaggagctgatgatgaccaccatcgggatcgtcctcctgtcccagagcaccatccccgagacgatcctggagctcaccgacgccctggcgctgggcatgatggtgctcaagatcgtgcgcaacatggagaagtaccagctggccgtcaccatcatggccatcctgtgcgtgccgaacgccgtcatcctccagaacgcctggaaggtgtcctgcaccatcctggcggtggtcagcgtgagccccctgctcctgacgagctcccagcagaagaccgactggatccccctggccctcaccatcaaggggctgaaccccaccgccatcttcctgacgaccctcagccgcaccaacaagaagcggtcctggccgctgaacgaggccatcatggcggtgggcatggtcagcatcctggcctccagcctcctgaagaacgacatccccatgaccggccccctggtggccgggggcctcctgacggtgtgctacgtcctgaccgggcgctccgccgacctcgagctggagcgggccaccgacgtgaagtgggaggaccaggcggagatcagcggcagctcccccatcctgagcatcaccatctccgaggacgggagcatgtccatcaagaacgaggaggaggagcagacgctcaccatcctgatccgcaccggcctgctcgtgatcagcggcctgttcccggtctccatccccatcaccgccgccgcctggtacctgtgggaggtgaagaagcagcgggccggggtgctctgggacgtcccctccccgccgcccatgggcaaggcggagctggaggacggggcctaccgcatcaagcagaagggcatcctggggtactcccagatcggcgccggcgtgtacaaggaggggaccttccacacgatgtggcacgtgacccggggcgccgtcctcatgcacaaggggaagcgcatcgagcccagctgggccgacgtgaagaaggacctgatctcctacggcgggggctggaagctggagggcgagtggaaggagggggaggaggtgcaggtcctcgcgctggagcccggcaagaacccccgggccgtgcagaccaagcccgggctgttcaagaccaacacgggcaccatcggggccgtgagcctcgacttctcccccggcaccagcggctcccccatcatcgacaagaaggggaaggtcgtgggcctgtacgggaacggcgtggtcacccgcagcggcgcctacgtgtccgccatcgcgcagacggagaagtccatcgaggacaaccccgagatcgaggacgacatcttccggaagcgccggctgaccatcatggacctgcaccccggggccggcaagaccaagcgctacctccccgccatcgtgcgggaggccatcaagcgcgggctgcggaccctgatcctcgcgccgacgcgcgtcgtggccgccgagatggaggaggccctgcggggcctgcccatccgctaccagacccccgccatccgggcggagcacaccgggcgcgagatcgtggacctcatgtgccacgccaccttcacgatgcgcctgctgtcccccgtccgggtgccgaactacaacctcatcatcatggacgaggcccacttcaccgaccccgccagcatcgccgcgcgcggctacatcagcacccgggtggagatgggcgaggccgccgggatcttcatgaccgccacgccgcccggctcccgcgacccgttcccccagagcaacgcccccatcatcgacgaggagcgggagatccccgagcgctcctggaacagcgggcacgagtgggtcaccgacttcaagggcaagaccgtgtggttcgtgccgtccatcaaggcggggaacgacatcgccgcctgcctgcggaagaacggcaagaaggtcatccagctgagccgcaagaccttcgactccgagtacgtgaagacgcggaccaacgactgggacttcgtggtcaccaccgacatcagcgagatgggcgccaacttcaaggcggagcgcgtgatcgacccccggcgctgcatgaagcccgtgatcctcacggacggggaggagcgggtcatcctggccggccccatgccggtgacccactccagcgccgcccagcgccgggggcgcatcggccggaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgcgagaaggtggacgccatcgacggcgagtaccggctgcgcggggaggcccgcaagaccttcgtcgacctcatgcggcgcggcgacctgcccgtgtggctggcctacaaggtggccgcggaggggatcaactacgccgaccggcgctggtgcttcgacggcatcaagaacaaccagatcctcgaggagaacgtcgaggtggagatctggacgaaggagggggagcggaagaagctgaagccgcgctggctggacgcccggatctacagcgaccccctcgccctgaaggagttcaaggagttcgccgcgggccgcaagtccctgaccctcaacctgatcaccgagatgggccggctgcccaccttcatgacgcagaagacccgcgacgccctcgacaacctggccgtcctgcacaccgccgaggccggcgggcgggcctacaaccacgccctcagcgagctgcccgagaccctggagacgctcctgctgctcaccctgctggccaccgtgaccggcgggatcttcctcttcctgatgtccgggcgcgggatcggcaagatgaccctggggatgtgctgcatcatcacggccagcatcctcctgtggtacgcgcagatccagccgcactggatcgccgcctccatcatcctggagttcttcctcatcgtgctgctgatccccgagcccgagaagcagcggacgccccaggacaaccagctcacctacgtcgtgatcgccatcctgaccgtggtcgccgcgacgatggccaacgagatgggcttcctggagaagaccaagaaggacctcgggctgggcggcatcgccacccagcagccggagagcaacatcctggacatcgacctccgccccgcctccgcctggaccctgtacgcggtggccacgaccttcgtgacccccatgctgcggcacagcatcgagaacagctccgtcaacgtgagcctcaccgccatcgccaaccaggccacggtgctgatggggctgggcaaggggtggcccctctccaagatggacatcggcgtcccgctgctggcgatcgggtgctacagccaggtgaaccccatcaccctcaccgccgccctgctgctcctggtggcccactacgcgatcatcggccccggcctgcaggccaaggccacccgcgaggcccagaagcgggccgcggccgggatcatgaagaaccccacggtcgacggcatcaccgtgatcgacctcgacccgatcccctacgaccccaagttcgagaagcagctgggccaggtgatgctgctcgtcctgtgcgtgacccaggtgctgatgatgcgcaccacgtgggccctctgcgaggccctgaccctggccaccggccccatctccaccctctgggaggggaacccgggccggttctggaacacgaccatcgcggtcagcatggccaacatcttccgcggctcctacctggccggggccggcctcctcttcagcatcatgaagaacaccaccaacacgcggcgcgggaccggcaacatcggcgagaccctgggggagaagtggaagtcccgcctgaacgccctcggcaagagcgagttccagatctacaagaagtccgggatccaggaggtggaccggaccctggcgaaggagggcatcaagcgcggggagacggaccaccacgccgtgagccggggctccgccaagctgcgctggttcgtcgagcggaacatggtgacccccgagggcaaggtggtcgacctcgggtgcggccgcgggggctggagctactactgcgggggcctgaagaacgtgcgggaggtgaagggcctgaccaagggcgggcccgggcacgaggagcccatcccgatgtccacctacggctggaacctcgtccgcctgcagagcggggtggacgtgttcttcatcccgcccgagaagtgcgacacgctgctctgcgacatcggcgagtccagccccaacccgaccgtcgaggccggccggaccctgcgcgtgctgaacctcgtggagaactggctgaacaacaacacccagttctgcatcaaggtcctgaacccctacatgccctccgtgatcgagaagatggaggcgctgcagcggaagtacgggggcgccctcgtgcgcaacccgctgagccggaacagcacccacgagatgtactgggtctccaacgccagcgggaacatcgtgtccagcgtgaacatgatctcccgcatgctgatcaaccggttcacgatgcgccacaagaaggccacctacgagcccgacgtcgacctcggcagcgggacccggaacatcggcatcgagtccgaggtgcccaacctggacatcatcggcaagcgcatcgagaagatcaagcaggagcacgagaccagctggcactacgaccaggaccacccctacaagacgtgggcctaccacgggtcctacgagaccaagcagaccggcagcgcgtccagcatggtgaacggggtcgtgcggctgctcaccaagccgtgggacgtgctgcccacggtcacccagatggccatgaccgacaccacgcccttcggccagcagcgcgtgttcaaggagaaggtggacacccgcacccaggagcccaaggagggcaccaagaagctgatgaagatcacggccgagtggctctggaaggagctggggaagaagaagaccccgcggatgtgcacccgcgaggagttcacccggaaggtccgctccaacgccgccctgggcgcgatcttcacggacgagaacaagtggaagtccgcccgggaggccgtggaggactcccgcttctgggagctcgtcgacaaggagcggaacctgcacctggaggggaagtgcgagacctgcgtgtacaacatgatgggcaagcgcgagaagaagctcggggagttcggcaaggccaagggcagccgggccatctggtacatgtggctgggggcgcgcttcctggagttcgaggccctcggcttcctgaacgaggaccactggttctcccgggagaacagcctgtccggggtggagggcgaggggctccacaagctgggctacatcctgcgcgacgtcagcaagaaggagggcgggaccatgtacgccgacgacaccgccggctgggacacgcggatcaccctcgaggacctgaagaacgaggagatggtgaccaaccacatggagggggagcacaagaagctggcggaggccatcttcaagctcacctaccagaacaaggtggtccgcgtgcagcggcccacgccccgcggcaccgtgatggacatcatcagccggcgcgaccagcgggggtccggccaggtcggcacctacgggctgaacaccttcacgaacatggaggcccagctgatccgccagatggagggcgagggggtgttcaagaacatccagcacctcaccgtgaccgaggagatcgccgtccagaactggctggcccgggtgggccgcgagcgcctgagccggatggcgatctccggcgacgactgcgtggtcaagcccctcgacgaccgcttcgccagcgccctgaccgccctgaacgacatggggaagatccggaaggacatccagcagtgggagccgtcccgcggctggaacgactggacccaggtgcccttctgcagccaccacttccacgagctcatcatgaaggacgggcgggtgctggtcgtgccctgccgcaaccaggacgagctgatcggccgggcccgcatctcccagggggcgggctggagcctccgggagaccgcctgcctgggcaagtcctacgcccagatgtggagcctgatgtacttccaccgccgggacctccgcctggccgccaacgcgatctgctccgccgtgcccagccactgggtcccgacctcccggaccacctggagcatccacgccaagcacgagtggatgacgaccgaggacatgctgaccgtgtggaaccgcgtgtggatccaggagaacccctggatggaggacaagacccccgtcgactcctgggaggagatcccctacctcgggaagcgggaggaccagtggtgcggcagcctgatcgggctgacgtcccgcgccacctgggccaagaacatccaggcggccatcaaccaggtgcggagcctcatcggcaacgaggagtacaccgactacatgccgagcatgaagcgcttccggcgcgaggaggaggaggccggggtgctgtggtga

SEQ ID NO: 9351 - RNA, 9876 nt, synthetic construct
  misc_feature 1..9876: note = derived and/or modified CDS sequence (opt1) from DENV-2__GQ868544__SS-prME
  source 1..9876: mol_type = other RNA
agcgtgggcatgatcatcatgctgatccccaccgtcatggccttccacctcaccacccggaacggggagccccacatgatcgtgagcatccaggagaagggcaagagcctgctgttcaagaccgaggacggggtgaacatgtgcaccctcatggccatggacctgggcgagctgtgcgaggacaccatcacctacaagtgccccctcctgcggcagaacgagcccgaggacatcgactgctggtgcaacagcaccagcacctgggtcacctacgggacgtgcaccaccaccggcgagcaccgccgggagaagcgctccgtggcgctggtgccccacgtcggcatggggctcgagacgcggaccgagacctggatgagctccgagggcgcctggaagcacgcccagcgcatcgagacctggatcctgcggcacccggggttcacgatcatggccgccatcctggcgtacaccatcggcaccacccacttccagcgcgccctcatcttcatcctgctgacggccgtggcccccagcatgaccatgcggtgcatcgggatctccaaccgcgacttcgtggagggcgtcagcggcgggtcctgggtggacatcgtgctcgagcacggcagctgcgtcaccaccatggcgaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtgtgcaagcactccatggtggaccgcggctggggcaacgggtgcggcctcttcgggaagggcgggatcgtcacgtgcgccatgttcacgtgcaagaagaacatggagggcaagatcgtgcagcccgagaacctggagtacaccatcgtggtcacgccccacagcggcgaggagcacgcggtggggaacgacacgggcaagcacgggaaggagatcaaggtgaccccgcagtccagcatcaccgaggccgagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacacccaggggagcaactggatccagaaggagaccctggtcacgttcaagaacccccacgccaagaagcaggacgtggtcgtgctcggcagccaggagggggcgatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtcaaggagatcgccgagacccagcacggcaccatcgtgatccgggtgcagtacgagggggacggctccccctgcaaggtccccttcgagatcatggacctggagaagcgctacgtgctcggccggctgatcacggtgaacccgatcgtcaccgagaaggacagccccgtgaacatcgaggccgagccgcccttcggggactcctacatcatcatcggcgtggagccggggcagctgaagctcaactggttcaagaagggcagctccatcgggcagatgttcgagaccaccatgcgcggcgcgaagcgcatggccatcctgggcgacacggcctgggacttcgggagcctgggcggggtcttcacctccatcggcaaggccctccaccaggtgttcggggccatctacggcgcggccttcagcggcgtgtcctggaccatgaagatcctgatcggggtcatcatcacctggatcggcatgaacagccggtccacgagcctgtccgtgagcctggtgctcgtcgggatcgtgaccctgtacctgggcgtgatggtccaggccgactccgggtgcgtggtgagctggaagaacaaggagctcaagtgcggcagcggcatcttcatcaccgacaacgtccacacctggacggagcagtacaagttccagcccgagtcccccagcaagctggcctccgcgatccagaaggcccaggaggaggggatctgcggcatccgcagcgtgacccggctggagaacctcatgtggaagcagatcacccccgagctgaaccacatcctggccgagaacgaggtgaagctcaccatcatgacgggggacatcaagggcatcatgcaggccgggaagcgctccctgcggccgcagcccaccgagctgaagtacagctggaagacctggggcaaggccaagatgctctccaccgagagccacaaccagacgttcctgatcgacggccccgagaccgcggagtgcccgaacaccaaccgcgcctggaactccctggaggtcgaggactacgggttcggcgtgttcaccacgaacatctggctcaagctgaaggagaagcaggacgccttctgcgacagcaagctgatgtccgccgccatcaaggacaaccgggcggtgcacgccgacatggggtactggatcgagagcgccctcaacgacacctggaagatcgagaaggcctccttcatcgaggtcaagaactgccactggcccaagagccacaccctgtggtccaacggcgtgctggagagcgagatgatcatccccaagaacctcgccggccccgtgtcccagcacaactaccgcccggggtaccacacccagatcgcgggcccctggcacctggggaagctggagatggacttcgacttctgcgacggcaccacggtcgtggtgaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgaccgccggccaggggcagatcgacaacttctccctgggcgtgctgggcatggccctcttcctggaggagatgctgcggacgcgcgtcgggaccaagcacgcgatcctcctggtggccgtgagcttcgtcaccctgatcaccggcaacatgtccttcaaggacctcgggcgggtggtggtcatggtgggcgccacgatgaccgacgacatcgggatgggcgtgacctacctggccctgctcgccgcgttcaaggtccgccccaccttcgccgccggcctgctgctccggaagctgacgagcaaggagctgatgatgaccaccatcgggatcgtgctcctgtcccagagcaccatccccgagacgatcctggagctcaccgacgccctggccctgggcatgatggtgctcaagatcgtccgcgacatggagaagtaccagctggcggtgaccatcatggccatcctgtgcgtcccgaacgccgtgatcctccagaacgcctggaaggtgtcctgcaccatcctggccgtcgtgagcgtgagccccctgctcctgacgagctcccagcagaagaccgactggatccccctggcgctcaccatcaaggggctgaaccccaccgccatcttcctgacgaccctcagccgcaccaacaagaagcggtcctggccgctgaacgaggccatcatggccgtcggcatggtgagcatcctggcgtccagcctcctgaagaacgacatccccatgaccggccccctggtggccgggggcctcctgacggtctgctacgtgctgaccgggcgctccgccgacctcgagctggagcgggccaccgacgtgaagtgggaggaccaggccgagatcagcggcagctcccccatcctgagcatcaccatctccgaggacgggagcatgtccatcaagaacgaggaggaggagcagacgctcaccatcctgatccgcaccggcctgctcgtcatcagcggcctgttcccggtgtccatccccatcaccgcggccgcctggtacctgtgggaggtgaagaagcagcgggccggggtcctctgggacgtgccctccccgccgcccatgggcaaggccgagctggaggacggggcgtaccgcatcaagcagaagggcatcctggggtactcccagatcggcgccggcgtgtacaaggaggggaccttccacacgatgtggcacgtcacccggggcgccgtgctcatgcacaaggggaagcgcatcgagcccagctgggccgacgtgaagaaggacctgatctcctacggcgggggctggaagctggagggcgagtggaaggagggggaggaggtccaggtgctcgccctggagcccggcaagaacccccgggcggtgcagaccaagcccgggctgttcaagaccaacacgggcaccatcggggccgtcagcctcgacttctcccccggcaccagcggctcccccatcatcgacaagaaggggaaggtggtgggcctgtacgggaacggcgtcgtgacccgcagcggcgcctacgtgtccgccatcgcccagacggagaagtccatcgaggacaaccccgacatcgaggacgacatcttccggaagcgccggctgaccatcatggacctgcaccccggggcgggcaagaccaagcgctacctccccgccatcgtccgggaggccatcaagcgcgggctgcggaccctgatcctcgccccgacgcgcgtggtggcggccgagatggaggaggccctgcggggcctgcccatccgctaccagacccccgccatccgggccgagcacaccgggcgcgagatcgtcgacctcatgtgccacgcgaccttcacgatgcgcctgctgtcccccgtgcgggtgccgaactacaacctcatcatcatggacgaggcccacttcaccgaccccgccagcatcgccgcccgcggctacatcagcacccgggtcgagatgggcgaggcggccgggatcttcatgaccgccacgccgcccggctcccgcgacccgttcccccagagcaacgcccccatcatcgacgaggagcgggagatccccgagcgctcctggaacagcgggcacgagtgggtgaccgacttcaagggcaagaccgtgtggttcgtcccgtccatcaaggccgggaacgacatcgcggcctgcctgcggaagaacggcaagaaggtgatccagctgagccgcaagaccttcgactccgagtacgtgaagacgcggaccaacgactgggacttcgtcgtgaccaccgacatcagcgagatgggcgccaacttcaaggccgagcgcgtgatcgacccccggcgctgcatgaagcccgtcatcctcacggacggggaggagcgggtgatcctggcgggccccatgccggtgacccactccagcgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgtccatgttcgagcccgagcgcgagaaggtcgacgcgatcgacggcgagtaccggctgcgcggggaggcccgcaagaccttcgtggacctcatgcggcgcggcgacctgcccgtgtggctggcctacaaggtcgccgccgaggggatcaactacgcggaccggcgctggtgcttcgacggcatcaagaacaaccagatcctcgaggagaacgtggaggtcgagatctggacgaaggagggggagcggaagaagctgaagccgcgctggctggacgcccggatctacagcgaccccctcgccctgaaggagttcaaggagttcgccgccggccgcaagtccctgaccctcaacctgatcaccgagatgggccggctgcccaccttcatgacgcagaagacccgcgacgcgctcgacaacctggccgtgctgcacaccgccgaggccgggggccgggcgtacaaccacgccctcagcgagctgcccgagaccctggagacgctcctgctgctcaccctgctggccaccgtgaccgggggcatcttcctcttcctgatgtccggccgcgggatcggcaagatgaccctggggatgtgctgcatcgtcacggccagcatcctcctgtggtacgcccagatccagccgcactggatcgcggcctccatcatcctggagttcttcctcatcgtgctgctgatccccgagcccgagaagcagcggacgccccaggacaaccagctcacctacgtggtcatcgccatcctgaccgtggtggccgccacgatggcgaacgagatgggcttcctggagaagaccaagaaggacctcgggctgggcagcatcgccacccagcagccggagtccaacatcctggacatcgacctccgccccgccagcgcctggaccctgtacgccgtcgcgacgaccttcgtgacccccatgctgcggcacagcatcgagaactccagcgtgaacgtctccctcaccgccatcgccaaccaggccacggtgctgatgggcctggggaagggctggcccctcagcaagatggacatcggggtgccgctgctggccatcggctgctactcccaggtcaaccccatcaccctcaccgcggccctgctgctcctggtggcccactacgccatcatcgggcccggcctgcaggcgaaggccacccgcgaggcccagaagcgggccgccgcgggcatcatgaagaaccccacggtggacgggatcaccgtcatcgacctcgacccgatcccctacgaccccaagttcgagaagcagctgggccaggtgatgctgctcgtgctgtgcgtcacccaggtgctgatgatgcgcaccacgtgggccctctgcgaggccctgaccctggccaccgggcccatcagcaccctctgggagggcaacccggggcggttctggaacacgaccatcgccgtgtccatggcgaacatcttccgcggcagctacctggccggcgccgggctcctgttctccatcatgaagaacaccaccaacacgcggcgcggcaccgggaacatcggcgagaccctgggcgagaagtggaagtcccgcctgaacgccctcgggaagtccgagttccagatctacaagaagtccggcatccaggaggtcgaccggaccctggccaaggaggggatcaagcgcggcgagacggaccaccacgcggtgtcccgggggagcgccaagctgcgctggttcgtggagcggaacatggtcacccccgagggcaaggtggtggacctcggctgcgggcgcggcgggtggtcctactactgcggcgggctgaagaacgtccgggaggtgaagggcctgaccaagggcgggcccggccacgaggagcccatcccgatgagcacctacgggtggaacctcgtgcgcctgcagtccggcgtcgacgtgttcttcatcccgcccgagaagtgcgacacgctgctctgcgacatcggggagagctcccccaacccgaccgtggaggccggccggaccctgcgcgtcctgaacctcgtggagaactggctgaacaacaacacccagttctgcatcaaggtgctgaacccctacatgcccagcgtcatcgagaagatggagaccctgcagcggaagtacggcggggccctcgtgcgcaacccgctgagccggaactccacgcacgagatgtactgggtgagcaacgcgtccggcaacatcgtcagctccgtgaacatgatcagccgcatgctgatcaaccggttcaccatgcgccacaagaaggccacctacgagcccgacgtggacctcgggtccggcacccggaacatcgggatcgagagcgagatccccaacctggacatcatcggcaagcgcatcgagaagatcaagcaggagcacgagacgtcctggcactacgaccaggaccacccctacaagacctgggcctaccacggcagctacgagaccaagcagaccgggtccgccagctccatggtcaacggcgtggtgcggctgctcacgaagccgtgggacgtcctgcccaccgtgacccagatggccatgaccgacacgacccccttcgggcagcagcgcgtgttcaaggagaaggtcgacacccgcacccaggagcccaaggagggcacgaagaagctgatgaagatcaccgcggagtggctctggaaggagctgggcaagaagaagaccccgcggatgtgcacccgcgaggagttcacgcggaaggtgcgcagcaacgccgccctgggggccatcttcaccgacgagaacaagtggaagtccgcccgggaggcggtcgaggacagccgcttctgggagctcgtggacaaggagcggaacctgcacctggagggcaagtgcgagacctgcgtgtacaacatgatggggaagcgcgagaagaagctcggcgagttcgggaaggccaagggctcccgggccatctggtacatgtggctgggcgcccgcttcctggagttcgaggccctcgggttcctgaacgaggaccactggttcagccgggagaactccctgagcggcgtcgagggggagggcctctacaagctggggtacatcctgcgcgacgtgagcaagaaggagggcggcgcgatgtacgccgacgacaccgccgggtgggacacgcggatcaccctcgaggacctgaagaacgaggagatggtgaccaaccacatggagggcgagcacaagaagctggccgaggcgatcttcaagctcacctaccagaacaaggtcgtgcgcgtgcagcggcccacgccccgcgggaccgtcatggacatcatctcccggcgcgaccagcggggcagcggccaggtggggacctacggcctgaacaccttcacgaacatggaggcccagctgatccgccagatggagggggagggcgtgttcaagaacatccagcacctcaccgtcaccgaggagatcgccgtgcagaactggctggcccgggtggggcgcgagcgcctgtcccggatggccatcagcggcgacgactgcgtcgtgaagcccctcgacgaccgcttcgcgtccgccctgaccgccctgaacgacatgggcaagatccggaaggacatccagcagtgggagccgagccgcgggtggaacgactggacccaggtgcccttctgctcccaccacttccacgagctcatcatgaaggacggccgggtcctggtggtgccctgccgcaaccaggacgagctgatcgggcgggcccgcatcagccagggcgccgggtggtccctccgggagaccgcgtgcctgggcaagagctacgcccagatgtggtccctgatgtacttccaccgccgggacctccgcctggccgccaacgccatctgcagcgcggtcccctcccactgggtgccgaccagccggaccacctggtccatccacgccaagcacgagtggatgacgaccgaggacatgctgaccgtgtggaaccgcgtctggatccaggagaacccctggatggaggacaagacccccgtggagagctgggaggagatcccctacctcggcaagcgggaggaccagtggtgcgggtccctgatcggcctgacgagccgcgccacctgggccaagaacatccaggccgcgatcaaccaggtgcggagcctcatcgggaacgaggagtacaccgactacatgccgtccatgaagcgcttccggcgcgaggaggaggaggccggcgtcctgtggtga

SEQ ID NO: 9352 - RNA, 9876 nt, synthetic construct
  misc_feature 1..9876: note = derived and/or modified CDS sequence (opt1) from DENV-2__GQ868545__SS-prME
  source 1..9876: mol_type = other RNA
agcgcgggcatgatcatcatgctgatccccaccgtgatggcgttccacctcaccacccgcaacggggagccccacatgatcgtcagcatccaggagaagggcaagagcctgctgttcaagaccgaggacggggtgaacatgtgcaccctcatggcgatggacctgggcgagctgtgcgaggacaccatcacctacaagtgccccctcctgcggcagaacgagcccgaggacatcgactgctggtgcaacagcaccagcacctgggtgacctacgggacctgcaccaccaccggcgagcaccgccgggagaagcgctccgtcgccctggtgccccacgtgggcatggggctcgagacccggaccgagacctggatgagctccgagggcgcctggaagcacgcccagcgcatcgagacctggatcctgcggcacccggggttcaccatcatggccgcgatcctggcctacaccatcggcaccacccacttccagcgcgccctcatcttcatcctgctgacggccgtcgcgcccagcatgaccatgcggtgcatcgggatctccaaccgcgacttcgtggagggcgtgagcggcgggtcctgggtcgacatcgtgctcgagcacggcagctgcgtgaccaccatggccaagaacaagcccacgctggacttcgagctgatcaagaccgaggccaagcagcccgccaccctccggaagtactgcatcgaggccaagctgaccaacacgaccaccgagtcccgctgccccacccagggggagcccagcctgaaggaggagcaggacaagcggttcgtctgcaagcactccatcgtggaccgcggctggggcaacgggtgcggcctcttcgggaagggcgggatcgtgacgtgcgcgatgttcacgtgcaagaagaacatggagggcaagatcgtccagcccgagaacctggagtacaccatcgtggtgacgccccacagcggcgaggagcacgccgtcgggaacgacacgggcaagcacgggaaggagatcaaggtgaccccgcagtccagcgtgaccgaggccgagctgaccggctacgggaccgtcacgatggagtgcagcccccggaccggcctcgacttcaacgagatggtgctgctgcagatggagaacaaggcctggctcgtgcaccgccagtggttcctggacctgcccctcccctggctgccgggcgccgacacccaggggagcaactggatccagaaggagaccctggtcacgttcaagaacccccacgcgaagaagcaggacgtggtcgtgctcggcagccaggagggggccatgcacaccgccctgaccggcgccaccgagatccagatgtccagcgggaacctcctgttcacgggccacctgaagtgccggctgcgcatggacaagctccagctgaagggcatgtcctacagcatgtgcaccgggaagttcaaggtggtcaaggagatcgccgagacccagcacggcaccatcgtgatccgggtgcagtacgagggggacggctccccctgcaagatccccttcgagatcatggacctggagaagcgctacgtcctcggccggctgatcacggtgaacccgatcgtgaccgagaaggacagccccgtcaacatcgaggcggagccgcccttcggggactcctacatcatcatcggcgtggagccggggcagctgaagctcaactggttcaagaagggcagctccatcgggcagatgttcgagaccaccatgcgcggcgccaagcgcatggccatcctgggcgacacggcctgggacttcgggagcctgggcggggtgttcacctccatcggcaaggccctccaccaggtcttcggggcgatctacggcgccgccttcagcggcgtgtcctggaccatgaagatcctgatcggggtgatcatcacctggatcggcatgaacagccggtccacgagcctgtccgtcagcctggtgctcgtggggatcgtcaccctgtacctgggcgtgatggtgcaggccgactccgggtgcgtcgtgagctggaagaacaaggagctcaagtgcggcagcggcatcttcatcaccgacaacgtgcacacctggacggagcagtacaagttccagcccgagtcccccagcaagctggcgtccgccatccagaaggcccaggaggaggggatctgcggcatccgcagcgtcacccggctggagaacctcatgtggaagcagatcacccccgagctgaaccacatcctggccgagaacgaggtgaagctcaccatcatgacgggggacatcaagggcatcatgcaggccgggaagcgctccctgcggccgcagcccaccgagctgaagtacagctggaagacctggggcaaggcgaagatgctctccaccgagagccacaaccagacgttcctgatcgacggccccgagaccgccgagtgcccgaacaccaaccgcgcctggaactccctggaggtggaggactacgggttcggcgtcttcaccacgaacatctggctcaagctgaaggagaagcaggacgccttctgcgacagcaagctgatgtccgccgcgatcaaggacaaccgggccgtgcacgccgacatggggtactggatcgagagcgccctcaacgacacctggaagatcgagaaggcctccttcatcgaggtgaagaactgccactggcccaagagccacaccctgtggtccaacggcgtcctggagagcgagatgatcatccccaagaacctcgcgggccccgtgtcccagcacaactaccgcccggggtaccacacccagatcgccggcccctggcacctggggaagctggagatggacttcgacttctgcgacggcaccacggtggtcgtgaccgaggactgcgggaaccggggccccagcctccgcaccaccacggccagcggcaagctgatcaccgagtggtgctgccggtcctgcaccctgcccccgctccgctaccgcggggaggacggctgctggtacgggatggagatccgccccctgaaggagaaggaggagaacctggtgaacagcctcgtcaccgccggccacgggcagatcgacaacttctccctgggcgtgctgggcatggccctcttcctggaggagatgctgcggacgcgcgtggggaccaagcacgccatcctcctggtcgccgtgagcttcgtgaccctgatcaccggcaacatgtccttcaaggacctcgggcgggtcgtggtgatggtcggcgccacgatgaccgacgacatcgggatgggcgtgacctacctggccctgctcgcggccttcaaggtgcgccccaccctggccgccggcctgctcctgcggaagctgacgagcaaggagctcatgatgaccaccatcgggatcgtcctgctgtcccagagcaccatccccgagacgatcctcgagctgaccgacgccctggcgctcggcatgatggtgctgaagatcgtgcgcgacatggagaagtaccagctggccgtcaccatcatggccaccctctgcgtgccgaacgccgtcatcctgcagaacgcctggaaggtgtcctgcacgatcctggcggtggtcagcgtgagccccctcctgctgaccagctcccagcagaagaccgactggatccccctcgccctgaccatcaaggggctgaaccccacggccatcttcctcaccaccctgagccgcaccaacaagaagcggtcctggccgctgaacgaggccatcatggcggtgggcatggtcagcatcctcgcctccagcctgctgaagaacgacatccccatgacgggccccctcgtggccgggggcctgctgaccgtgtgctacgtcctcaccgggcgctccgccgacctggagctggagcgggccaccgacgtgaagtgggaggaccaggcggagatcagcggcagctcccccatcctcagcatcacgatctccgaggacgggagcatgtccatcaagaacgaggaggaggagcagaccctgaccatcctgatccgcaccggcctcctggtgatcagcggcctgttcccggtctccatccccatcaccgccgccgcctggtacctctgggaggtgaagaagcagcgggccggggtgctgtgggacgtcccctccccgccgcccatgggcaaggcggagctggaggacggggcctaccgcatcaagcagaagggcatcctcgggtactcccagatcggcgccggcgtgtacaaggaggggacgttccacaccatgtggcacgtgacccggggcgccgtcctgatgcacaaggggaagcgcatcgagcccagctgggccgacgtgaagaaggacctgatctcctacggcgggggctggaagctcgagggcgagtggaaggagggggaggaggtgcaggtcctggcgctggagcccggcaagaacccccgggccgtgcagaccaagcccggcctcttcaagacgaacaccggcaccatcggggccgtgagcctggacttctcccccggcaccagcggctcccccatcatcgacaagaaggggaaggtcgtgggcctgtacgggaacggcgtggtcacgcgcagcggcgcctacgtgtccgccatcgcgcagaccgagaagtccatcgaggacaaccccgacatcgaggacgacatcttccggaagcgccggctgaccatcatggacctccaccccggggccggcaagaccaagcgctacctgcccgccatcgtgcgggaggccatcaagcgcgggctgcggacgctcatcctggcgccgacccgcgtcgtggccgccgagatggaggaggccctgcggggcctccccatccgctaccagacccccgccatccgggcggagcacaccgggcgcgagatcgtggacctgatgtgccacgccacgttcaccatgcgcctgctctcccccgtccgggtgccgaactacaacctgatcatcatggacgaggcccacttcaccgaccccgccagcatcgccgcgcgcggctacatcagcacccgggtggagatgggcgaggccgccgggatcttcatgacggccacgccgcccggctcccgcgacccgttcccccagagcaacgcccccatcatcgacgaggagcgggagatccccgagcgctcctggaacagcgggcacgagtgggtcaccgacttcaagggcaagaccgtgtggttcgtgccgtccatcaaggcggggaacgacatcgccgcctgcctgcggaagaacggcaagaaggtcatccagctcagccgcaagacgttcgactccgagtacgtgaagacccggaccaacgactgggacttcgtggtcaccacggacatcagcgagatgggcgccaacttcaaggcggagcgcgtgatcgacccccggcgctgcatgaagcccgtgatcctgaccgacggggaggagcgggtcatcctggccggccccatgccggtgacccactccagcgccgcccagcgccgggggcgcatcggccggaaccccaagaacgagaacgaccagtacatctacatgggggagcccctcgagaacgacgaggactgcgcccactggaaggaggcgaagatgctgctggacaacatcaacacccccgagggcatcatcccgtccatgttcgagcccgagcgcgagaaggtggacgccatcgacggcgagtaccggctccgcggggaggcccgcaagacgttcgtcgacctgatgcggcgcggcgacctgcccgtgtggctcgcctacaaggtggccgcggaggggatcaactacgccgaccggcgctggtgcttcgacggcatcaagaacaaccagatcctggaggagaacgtcgaggtggagatctggaccaaggagggggagcggaagaagctgaagccgcgctggctcgacgcccggatctacagcgaccccctggccctgaaggagttcaaggagttcgccgcgggccgcaagtccctcaccctgaacctgatcaccgagatgggccggctccccacgttcatgacccagaagacccgcgacgccctggacaacctggccgtcctccacaccgccgaggccggcgggcgggcctacaaccacgccctgagcgagctgcccgagacgctcgagaccctgctgctcctgaccctgctcgccaccgtgaccggcgggatcttcctgttcctgatgtccgggcgcgggatcggcaagatgacgctcgggatgtgctgcatcatcaccgccagcatcctgctgtggtacgcgcagatccagccgcactggatcgccgcctccatcatcctcgagttcttcctgatcgtgctgctcatccccgagcccgagaagcagcggacgccccaggacaaccagctgacctacgtcgtgatcgccatcctgacggtggtcgccgcgaccatggccaacgagatgggcttcctcgagaagaccaagaaggacctggggctgggcagcatcgccacccagcagccggagtccaacatcctcgacatcgacctgcgccccgccagcgcctggacgctgtacgcggtggccaccaccttcgtgacccccatgctccggcacagcatcgagaactccagcgtcaacgtgtccctgacggccatcgccaaccaggccaccgtgctgatgggcctcgggaagggctggcccctgagcaagatggacatcggggtcccgctgctcgcgatcggctgctactcccaggtgaaccccatcaccctgaccgccgccctgctcctgctggtggcccactacgcgatcatcgggcccggcctccaggccaaggccacgcgcgaggcccagaagcgggccgcggccggcatcatgaagaaccccaccgtcgacgggatcaccgtgatcgacctggacccgatcccctacgaccccaagttcgagaagcagctgggccaggtgatgctcctggtcctgtgcgtgacccaggtgctcatgatgcgcacgacctgggccctgtgcgaggccctgaccctcgccaccgggcccatcagcacgctgtgggagggcaacccggggcggttctggaacaccaccatcgcggtctccatggccaacatcttccgcggcagctacctggccggcgccgggctcctgttctccatcatgaagaacaccacgaacacccggcgcggcaccgggaacatcggcgagaccctgggcgagaagtggaagtcccgcctcaacgccctggggaagtccgagttccagatctacaagaagtccggcatccaggaggtggaccggacgctggcgaaggaggggatcaagcgcggcgagaccgaccaccacgccgtgtcccgggggagcgccaagctccgctggttcgtcgagcggaacatggtgacccccgagggcaaggtggtcgacctgggctgcgggcgcggcgggtggtcctactactgcggcgggctgaagaacgtgcgggaggtgaagggcctcaccaagggcgggcccggccacgaggagcccatcccgatgagcacgtacgggtggaacctggtccgcctgcagtccggcgtggacgtgttcttcatcccgcccgagaagtgcgacaccctcctgtgcgacatcggggagagctcccccaacccgaccgtcgaggccggccggaccctgcgcgtgctcaacctggtggagaactggctgaacaacaacacccagttctgcatcaaggtcctgaacccctacatgcccagcgtgatcgagaagatggagacgctccagcggaagtacggcggggcgctggtgcgcaacccgctgagccggaactccacccacgagatgtactgggtcagcaacgcctccggcaacatcgtgagctccgtgaacatgatcagccgcatgctcatcaaccggttcaccatgcgccacaagaaggccacctacgagcccgacgtcgacctggggtccggcacgcggaacatcgggatcgagagcgagatccccaacctggacatcatcggcaagcgcatcgagaagatcaagcaggagcacgagacctcctggcactacgaccaggaccacccctacaagacctgggcctaccacggcagctacgagaccaagcagacggggtccgccagctccatggtgaacggcgtggtccggctcctgaccaagccgtgggacgtgctgcccaccgtgacccagatggcgatgacggacaccacccccttcgggcagcagcgcgtcttcaaggagaaggtggacacccgcacgcaggagcccaaggagggcaccaagaagctcatgaagatcaccgccgagtggctgtggaaggagctgggcaagaagaagaccccgcggatgtgcacgcgcgaggagttcacccggaaggtgcgcagcaacgccgccctcggggccatcttcaccgacgagaacaagtggaagtccgcgcgggaggccgtcgaggacagccgcttctgggagctggtggacaaggagcggaagctgcacctcgagggcaagtgcgagacctgcgtctacaacatgatggggaagcgcgagaagaagctgggcgagttcgggaaggccaagggctcccgggccatctggtacatgtggctgggcgcccgcttcctcgagttcgaggcgctggggttcctgaacgaggaccactggttcagccgggagaactccctcagcggcgtggagggggagggcctgcacaagctggggtacatcctccgcgacgtgagcaagaaggagggcggcgccatgtacgccgacgacacggccgggtgggacacccggatcaccctggaggacctgaagaacgaggagatggtcaccaaccacatggagggcgagcacaagaagctcgcggaggccatcttcaagctgacgtaccagaacaaggtggtgcgcgtccagcggcccacgccccgggggaccgtgatggacatcatctcccggcgcgaccagcggggcagcggccaggtggggacctacggcctgaacacgttcaccaacatggaggcccagctcatccgccagatggagggggagggcgtcttcaagaacatccagcacctgaccgtgaccgaggagatcgccgtgcagaactggctggcccgggtcgggcgcgagcgcctctcccggatggcgatcagcggcgacgactgcgtggtgaagcccctggacgaccgcttcgcctccgccctgacggccctcaacgacatgggcaagatccggaaggacatccagcagtgggagccgagccgcgggtggaacgactggacccaggtccccttctgctcccaccacttccacgagctgatcatgaaggacggccgggtgctggtggtcccctgccgcaaccaggacgagctcatcgggcgggcccgcatcagccagggcgcggggtggtccctgcgggagaccgcctgcctgggcaagagctacgcccagatgtggtccctcatgtacttccaccgccgggacctgcgcctggccgccaacgcgatctgcagcgccgtgccctcccactgggtgccgaccagccggaccacgtggtccatccacgccaagcacgagtggatgaccaccgaggacatgctcaccgtctggaaccgcgtgtggatccaggagaacccctggatggaggacaagacgcccgtggagagctgggaggagatcccctacctgggcaagcgggaggaccagtggtgcgggtccctgatcggcctcaccagccgcgccacctgggccaagaacatccaggcggccatcaaccaggtccggagcctgatcgggaacgaggagtacaccgactacatgccgtccatgaagcgcttccggcgcgaggaggaggaggccggcgtgctgtggtga

SEQ ID NO: 9353 - RNA, 9876 nt, synthetic construct
  misc_feature 1..9876: note = derived and/or modified CDS sequence (opt1) from DENV-2__GQ868543__SS-prME
  source 1..9876: mol_type = other RNA
agcgccggcatgatcatcatgctgatccccaccgtgatggccttccacctcaccacccgcaacggggagccccacatgatcgtgggcatccaggagaaggggaagtccctgctgttcaagaccgaggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccgccgggagaagcgcagcgtcgccctggtgccccacgtggggatgggcctcgagacccggaccgagacctggatgtccagcgagggggcctggaagcacgcccagcgcatcgagacctggatcctgcggcacccgggcttcacgatcatggccgcgatcctggcctacaccatcgggaccacccacttccagcgcgccctcatcttcatcctgctgacggccgtcgcgccctccatgaccatgcggtgcatcggcatcagcaaccgcgacttcgtggagggcgtgtccgggggcagctgggtcgacatcgtgctcgagcacgggtcctgcgtgaccaccatggccaagaacaagcccacgctggacttcgagctgatcaagaccgaggccaagcagcccgccaccctccggaagtactgcatcgaggccaagctgaccaacacgaccaccgagagccgctgccccacccagggcgagccctccctgaaggaggagcaggacaagcggttcgtctgcaagcacagcatggtggaccgcggctgggggaacggctgcgggctgttcggcaagggcgggatcgtgacgtgcgcgatgttcacgtgcaagaagaacatggagggcaagatcgtccagcccgagaacctggagtacaccatcgtggtgacgccccactccggggaggagcacgccgtcggcaacgacacggggaagcacggcaaggagatcaaggtgaccccgcagagctccatcaccgaggccgagctgaccgggtacggcaccgtgacgatggagtgcagcccccggaccggcctcgacttcaacgagatggtcctgctgcagatggagaacaaggcctggctcgtgcaccgccagtggttcctggacctgcccctcccctggctgccgggggccgacaagcagggctccaactggatccagaaggagaccctggtgaccttcaagaacccccacgcgaagaagcaggacgtcgtggtcctcgggagccaggagggcgccatgcacacggccctgaccggggccaccgagatccagatgagctccggcaacctcctgttcaccggccacctgaagtgccggctgcgcatggacaagctccagctgaaggggatgagctactccatgtgcacgggcaagttcaaggtggtgaaggagatcgccgagacccagcacgggaccatcgtcatccgggtgcagtacgagggcgacggcagcccctgcaagatccccttcgagatcatggacctggagaagcgctacgtgctcgggcggctgatcaccgtcaacccgatcgtgacggagaaggactcccccgtgaacatcgaggcggagccgcccttcggcgacagctacatcatcatcggggtcgagccgggccagctgaagctcaactggttcaagaaggggtccagcatcggccagatgttcgagaccaccatgcgcggcgccaagcgcatggccatcctgggggacaccgcctgggacttcggctccctcggcgggatgttcacgagcatcgggaaggccctccaccaggtgttcggcgcgatctacggcgccgccttctccggggtgagctggaccatgaagatcctgatcggcgtcatcatcacctggatcgggatgaactcccggagcacctccctgagcgtgtccctggtgctcgtcggcatcgtgacgctgtacctgggggtgatggtccaggccgacagcggctgcgtggtgtcctggaagaacaaggagctcaagtgcggcagcgggatcttcatcaccgacaacgtccacacctggaccgagcagtacaagttccagcccgagagcccctccaagctggcgagcgccatccagaaggcccaggaggagggcatctgcgggatccgctccgtgacgcggctggagaacctcatgtggaagcagatcacccccgagctgaaccacatcctggccgagaacgaggtgaagctcaccatcatgaccggcgacatcaaggggatcatgcaggccggcaagcgcagcctgcggccgcagcccacggagctgaagtactcctggaagacctggggcaaggcgaagatgctcagcaccgagtcccacaaccagaccttcctgatcgacgggcccgagacggccgagtgcccgaacaccaaccgcgcctggaacagcctggaggtcgaggactacggcttcggggtgttcaccaccaacatctggctcaagctgaaggagaagcaggacgccttctgcgactccaagctgatgagcgccgcgatcaaggacaaccgggccgtgcacgccgacatgggctactggatcgagtccgccctcaacgacacgtggaagatcgagaaggccagcttcatcgaggtcaagaactgccactggcccaagtcccacaccctgtggagcaacggcgtgctggagtccgagatgatcatccccaagaacctcgcggggcccgtgagccagcacaactaccgcccgggctaccacacccagatcgccgggccctggcacctgggcaagctggagatggacttcgacttctgcgacgggaccaccgtcgtggtgacggaggactgcggcaaccggggcccctccctccgcaccaccaccgccagcgggaagctgatcacggagtggtgctgccggagctgcaccctgcccccgctccgctaccggggcgaggacgggtgctggtacggcatggagatccgccccctgaaggagaaggaggagaacctggtcaactccctcgtgaccgccgggcacggccaggtggacaacttcagcctgggcgtcctggggatggccctgttcctggaggagatgctgcggacccgcgtgggcacgaagcacgccatcctcctggtggccgtctccttcgtgaccctgatcaccgggaacatgagcttcaaggacctcggccgggtggtcgtgatggtgggggccaccatgacggacgacatcggcatgggcgtcacctacctggccctgctcgcggccttcaaggtgcgccccaccttcgccgccgggctgctgctccggaagctgacctccaaggagctgatgatgacgaccatcggcatcgtgctcctgagccagtccaccatccccgagaccatcctggagctcacggacgccctggcgctggggatgatggtcctcaagatcgtgcgcaacatggagaagtaccagctggccgtgaccatcatggccatcctgtgcgtcccgaacgccgtgatcctccagaacgcctggaaggtcagctgcaccatcctggcggtggtgtccgtcagccccctgctcctgacctccagccagcagaagacggactggatccccctggccctcaccatcaagggcctgaaccccaccgccatcttcctgaccacgctctcccgcaccaacaagaagcggagctggccgctgaacgaggccatcatggcggtgggcatggtgtccatcctggccagctccctcctgaagaacgacatccccatgaccgggcccctggtcgccggcgggctcctgaccgtgtgctacgtgctgacgggccgcagcgccgacctcgagctggagcgggccaccgacgtcaagtgggaggaccaggcggagatctccgggagcagccccatcctgtccatcaccatcagcgaggacggctccatgagcatcaagaacgaggaggaggagcagaccctcacgatcctgatccgcaccggcctgctcgtgatctccgggctgttcccggtgagcatccccatcaccgccgccgcctggtacctgtgggaggtcaagaagcagcgggccggcgtgctctgggacgtgcccagcccgccgcccatggggaaggcggagctggaggacggcgcctaccgcatcaagcagaaggggatcctgggctacagccagatcggcgccggggtctacaaggagggcaccttccacaccatgtggcacgtgacgcgcggggcggtgctcatgcacaagggcaagcgcatcgagccctcctgggccgacgtcaagaaggacctgatcagctacgggggcggctggaagctggagggggagtggaaggagggcgaggaggtccaggtgctcgcgctggagcccgggaagaacccccgggccgtccagaccaagcccggcctgttcaagaccaacaccgggacgatcggcgccgtgtccctcgacttcagccccggcacctccgggagccccatcatcgacaagaagggcaaggtggtcgggctgtacggcaacggcgtggtgacccgctccggggcctacgtcagcgccatcgcgcagaccgagaagtccatcgaggacaaccccgagatcgaggacgacatcttccggaagcgccggctgacgatcatggacctgcaccccggcgccgggaagaccaagcgctacctccccgccatcgtgcgggaggccatcaagcgcggcctgcggaccctgatcctcgcgccgacccgcgtggtcgccgccgagatggaggaggccctgcgggggctgcccatccgctaccagacgcccgccatccgggcggagcacaccggccgcgagatcgtggacctcatgtgccacgccaccttcaccatgcgcctgctgagccccgtgcgggtcccgaactacaacctcatcatcatggacgaggcccacttcacggaccccgcctccatcgccgcgcgcggctacatcagcacccgggtggagatgggggaggccgccggcatcttcatgaccgccacgccgcccgggagccgcgacccgttcccccagtccaacgcccccatcatcgacgaggagcgggagatccccgagcgcagctggaactccggccacgagtgggtgacggacttcaaggggaagaccgtctggttcgtgccgagcatcaaggcgggcaacgacatcgccgcctgcctgcggaagaacggcaagaaggtgatccagctgtcccgcaagaccttcgacagcgagtacgtcaagacccggacgaacgactgggacttcgtggtgaccaccgacatctccgagatgggggccaacttcaaggcggagcgcgtcatcgacccccggcgctgcatgaagcccgtgatcctcaccgacggcgaggagcgggtgatcctggccgggcccatgccggtcacgcacagctccgccgcccagcgccggggccgcatcgggcggaaccccaagaacgagaacgaccagtacatctacatgggcgagcccctggagaacgacgaggactgcgcccactggaaggaggcgaagatgctcctggacaacatcaacacccccgagggcatcatcccgagcatgttcgagcccgagcgcgagaaggtggacgccatcgacggggagtaccggctgcgcggcgaggcccgcaagaccttcgtggacctcatgcggcgcggggacctgcccgtctggctggcctacaaggtggccgcggagggcatcaactacgccgaccggcgctggtgcttcgacgggatcaagaacaaccagatcctcgaggagaacgtggaggtcgagatctggaccaaggagggcgagcggaagaagctgaagccgcgctggctggacgcccggatctactccgaccccctcgccctgaaggagttcaaggagttcgccgcgggccgcaagagcctgacgctcaacctgatcaccgagatggggcggctgcccaccttcatgacccagaagacgcgcgacgccctcgacaacctggccgtgctgcacaccgccgaggcgggcgggcgggcctacaaccacgccctctccgagctgcccgagaccctggagaccctcctgctgctcacgctgctggccaccgtcaccggcggcatcttcctcttcctgatgagcgggcgcggcatcgggaagatgaccctgggcatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacctacgtggtcatcgccatcctgaccgtggtggccgcgaccatggccaacgagatggggttcctggagaagacgaagaaggacctcggcctgggctccatcgccacccagcagccggagagcaacatcctggacatcgacctccgccccgcctccgcctggaccctgtacgcggtcgccaccacgttcgtgacccccatgctgcggcacagcatcgagaacagctccgtgaacgtcagcctcaccgccatcgccaaccaggccaccgtgctgatggggctgggcaaggggtggcccctctccaagatggacatcggcgtgccgctgctggcgatcgggtgctacagccaggtcaaccccatcacgctcaccgccgccctgctgctcctggtggcccactacgcgatcatcggccccggcctgcaggccaaggccacccgcgaggcccagaagcgggccgcggccgggatcatgaagaaccccaccgtggacggcatcacggtcatcgacctcgacccgatcccctacgaccccaagttcgagaagcagctgggccaggtgatgctgctcatcctgtgcgtgacccaggtcctgatgatgcgcaccacctgggccctctgcgaggccctgacgctggtgaccggccccatctccaccctctgggaggggaacccgggccggttctggaacaccacgatcgccgtgagcatggcgaacatcttccgcggctcctacctggccggggccggcctcctcttcagcatcatgaagaacaccaccaacacccggcgcgggacgggcaacatcggcgagaccctgggggagaagtggaagtcccgcctgaacgccctcggcaagagcgagttccagatctacaagaagtccgggatccaggaggtcgaccggaccctggccaaggagggcatcaagcgcggggagaccgaccaccacgcggtgagccggggctccgccaagctgcgctggttcgtggagcggaacatggtcacgcccgagggcaaggtggtggacctcgggtgcggccgcgggggctggagctactactgcgggggcctgaagaacgtccgggaggtgaagggcctgaccaagggcgggcccgggcacgaggagcccatcccgatgtccacctacggctggaacctcgtgcgcctgcagagcggggtcgacgtgttcttcatcccgcccgagaagtgcgacaccctgctctgcgacatcggcgagtccagccccaacccgacggtggaggccggccggaccctgcgcgtcctgaacctcgtggagaactggctgaacaacaacacccagttctgcatcaaggtgctgaacccctacatgccctccgtcatcgagaagatggaggccctgcagcggaagtacgggggcgcgctcgtgcgcaacccgctgagccggaacagcacccacgagatgtactgggtgtccaacgccagcgggaacatcgtctccagcgtgaacatgatctcccgcatgctgatcaaccggttcaccatgcgccacaagaaggccacgtacgagcccgacgtggacctcggcagcgggacccggaacatcggcatcgagtccgagatccccaacctggacatcatcggcaagcgcatcgagaagatcaagcaggagcacgagaccagctggcactacgaccaggaccacccctacaagacctgggcctaccacgggtcctacgagacgaagcagaccggcagcgcctccagcatggtcaacggggtggtgcggctgctcaccaagccgtgggacgtcctgcccaccgtgacgcagatggcgatgaccgacaccacccccttcggccagcagcgcgtgttcaaggagaaggtcgacacgcgcacccaggagcccaaggagggcaccaagaagctgatgaagatcaccgccgagtggctctggaaggagctggggaagaagaagacgccgcggatgtgcacccgcgaggagttcacccggaaggtgcgctccaacgccgccctgggcgccatcttcaccgacgagaacaagtggaagtccgcgcgggaggccgtggaggactcccgcttctgggagctcgtcgacaaggagcggaacctgcacctggaggggaagtgcgagacgtgcgtgtacaacatgatgggcaagcgcgagaagaagctcggggagttcggcaaggccaagggcagccgggccatctggtacatgtggctgggggcccgcttcctggagttcgaggcgctcggcttcctgaacgaggaccactggttctcccgggagaacagcctgtccggggtcgagggcgaggggctccacaagctgggctacatcctgcgcgacgtgagcaagaaggagggcggggccatgtacgccgacgacaccgccggctgggacacccggatcaccctcgaggacctgaagaacgaggagatggtgacgaaccacatggagggggagcacaagaagctggcggaggccatcttcaagctcacctaccagaacaaggtcgtgcgcgtgcagcggcccacgccccggggcaccgtcatggacatcatcagccggcgcgaccagcgggggtccggccaggtgggcacgtacgggctgaacaccttcaccaacatggaggcccagctgatccgccagatggagggcgagggggtgttcaagaacatccagcacctcaccgtcacggaggaggtggccgtgcagaactggctggcccgggtcggccgcgagcgcctgagccggatggcgatctccggcgacgactgcgtggtgaagcccctcgacgaccgcttcgccaacgccctgaccgccctgaacgacatggggaagatccggaaggacatccagcagtgggagccgagcaagggctggaacgactggacccaggtccccttctgctcccaccacttccacgagctcatcatgaaggacgggcgcgtgctggtggtcccctgccggaaccaggacgagctgatcggccgcgcccggatcagccagggggcgggctggtccctccgcgagaccgcctgcctgggcaagagctacgcccagatgtggtccctgatgtacttccaccggcgcgacctccggctggccgccaacgcgatctgcagcgccgtgccctcccactgggtgccgacgagccgcaccacctggtccatccacgccaagcacgagtggatgaccaccgaggacatgctgacggtctggaaccgggtgtggatccaggagaacccctggatggaggacaagacccccgtggagagctgggaggagatcccctacctcgggaagcgcgaggaccagtggtgcggctccctgatcgggctgaccagccgggccacctgggccaagaacatccaggcggccatcaaccaggtccgctccctcatcggcaacgaggagtacacggactacatgccgagcatgaagcggttccgccgggaggaggaggaggccggggtgctgtggtga

SEQ ID NO: 9354 - RNA, 9876 nt, synthetic construct
  misc_feature 1..9876: note = derived and/or modified CDS sequence (opt1) from DENV-2__EU482544__SS-prME
  source 1..9876: mol_type = other RNA
accgccggcgtgatcatcatgctgatccccaccgtcatggccttccacctcaccacccggaacggggagccccacatgatcgtgggccggcaggagaaggggaagtccctgctgttcaagaccgaggacggcgtgaacatgtgcaccctcatggcgatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagcagcgagggggcctggaagcacgtgcagcggatcgagacgtggatcctgcgccacccgggcttcaccatcatggccgccatcctggcgtacaccatcgggaccacgcacttccagcgggccctcatcttcatcctgctgaccgccgtggcccccagcatgaccatgcgctgcatcggcatctccaaccgggacttcgtcgagggcgtgagcgggggctcctgggtggacatcgtcctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgccatgttcacgtgcaagaagaacatggagggcaaggtggtgctgcccgagaacctggagtacaccatcgtcatcacgccccacagcggggaggagcacgcggtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgccaagaagcaggacgtcgtggtcctggggtcccaggagggcgcgatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggccgagccgcccttcggcgactcctacatcatcatcggggtggagccgggccagctcaagctgaactggttcaagaaggggagctccatcggccagatgttcgagaccacgatgcgcggcgcgaagcggatggccatcctgggggacaccgcctgggacttcggcagcctcgggggcgtcttcacctccatcgggaaggccctgcaccaggtgttcggcgccatctacggcgcggccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgacaccggctgcgtggtctcctggaagaacaaggagctgaagtgcggcagcgggatcttcatcacggacaacgtgcacacctggaccgagcagtacaagttccagcccgagtcccccagcaagctggccagcgcgatccagaaggcccacgaggagggcatctgcgggatccggtccgtgacccgcctcgagaacctgatgtggaagcagatcacgcccgagctgaaccacatcctcagcgagaacgaggtcaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgccgagtgcccgaacacgaaccgggcgtggaactccctcgaggtggaggactacggcttcggggtgttcagcaccaacatctggctgaagctgcgcgagaagcaggacgtcttctgcgactccaagctcatgagcgccgccatcaaggacaaccgggccgtgcacgccgacatgggctactggatcgagtccgcgctgaacgacacctggaagatggagaaggccagcttcatcgagatcaagtcctgccactggcccaagagccacaccctgtggtccaacggcgtgctcgagagcgagatgatcatccccaagaacttcgccgggcccgtctcccagcacaactaccgcccgggctaccacacccagacggccgggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgcggggcacggccagatcgacaacttctccctgggcgtcctggggatggccctcttcctggaggagatgctgcggacccgcgtgggcaccaagcacgccatcctcctggtggccgtcagcttcgtgacgctgatcaccgggaacatgtccttccgggacctcggccgcgtgatggtcatggtgggggcgaccatgaccgacgacatcggcatgggcgtgacgtacctggccctgctcgccgccttcaaggtccgccccaccttcgccgcggggctgctgctccggaagctgaccagcaaggagctgatgatggccaccatcggcatcgccctcctgtcccagagcacgatccccgagaccatcctggagctcaccgacgccctggccctggggatgatggtgctcaagatcgtgcgcaacatggagaagtaccagctggcggtcaccatcatggccatctcctgcgtgccgaacgccgtgatcctgcagaacgcctggaaggtcagctgcacgatcctcgccgcggtgtccgtcagccccctgctgctcacctccagccagcagaaggccgactggatccccctggccctgaccatcaagggcctcaaccccaccgccatcttcctgacgaccctgtcccggaccagcaagaagcgctcctggccgctcaacgaggcggtgatggccgtgggcatggtcagcatcctggcctccagcctgctcaagaacgacatccccatgaccgggcccctggtggccggcgggctgctcacggtgtgctacgtcctgaccggccggagcgccgacctggagctcgagcgcgcggccgacgtgaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtcttcccggtgtccatccccatcaccgccgccgcgtggtacctctgggaggtgaagaagcagcgcgccggcgtcctgtgggacgtgcccagcccgccgcccgtggggaaggccgagctggaggacggcgcctaccggatcaagcagcgcgggatcttcggctactcccagatcggcgccggggtctacaaggagggcaccttccacaccatgtggcacgtgacgcgcggggcggtgctcatgcaccgcggcaagcggatcgagcccagctgggccgacgtcaagaaggacctgatctcctacgggggcggctggaagctggagggggagtggaaggagggcgaggaggtccaggtgctcgccctggagcccgggaagaacccccgcgccgtccagaccaagcccggcctgttcaagaccaacaccgggacgatcggcgccgtgagcctcgacttctcccccggcaccagcgggtcccccatcgtggaccggaagggcaaggtcgtggggctgtacggcaacggcgtggtcacccgcagcggggcgtacgtgtccgccatcgcccagaccgagaagtccatcgaggacaaccccgagatcgaggacgacatcttccggaagaagcgcctgacgatcatggacctccaccccggcgccgggaagaccaagcggtacctgcccgcgatcgtgcgcgaggccatcaagcggggcctgcgcaccctgatcctcgccccgacccgcgtcgtggccgccgagatggaggaggcgctgcgggggctgcccatccgctaccagacgcccgccatccgggccgagcacaccggccgcgagatcgtggacctcatgtgccacgccaccttcaccatgcggctgctgagccccgtccgcgtgccgaactacaacctcatcatcatggacgaggcccacttcacggaccccgcgtccatcgccgcccggggctacatcagcacccgcgtggagatgggggaggccgccggcatcttcatgaccgcgacgccgcccgggtcccgggacccgttcccccagagcaacgcccccatcatggacgaggagcgcgagatccccgagcggtcctggaacagcggccacgagtgggtcacggacttcaaggggaagaccgtgtggttcgtgccgtccatcaaggccggcaacgacatcgccgcgtgcctgcgcaagaacggcaagaaggtcatccagctgagccggaagaccttcgactccgagtacgtgaagacccgcgccaacgactgggacttcgtggtcacgaccgacatcagcgagatgggggccaacttccgggccgagcgcgtgatcgacccccggcgctgcatgaagcccgtgatcctcaccgacggcgaggagcgggtcatcctggccgggcccatgccggtgacccactccagcgcggcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgccatcgacggggagtaccgcctgcggggcgaggcgcgcaagaccttcgtcgacctcatgcggcgcggggacctgcccgtgtggctggcctaccgggtggccgccgagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcgcgcatctacagcgaccccctcgccctgaaggagttcaaggagttcgccgccggccggaagtccctgaccctcaacctgatcacggagatggggcgcctgcccaccttcatgacccagaaggcgcgggacgccctcgacaacctggccgtcctgcacaccgccgaggtgggcgggcgcgcctacaaccacgcgctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgccgcgtccatcatcctggagttcttcctcatcgtcctgctgatccccgagcccgagaagcagcggacgccccaggacaaccagctcacctacgtggtgatcgccatcctgacggtcgtggccgccaccatggccaacgagatggggttcctggagaagaccaagaaggacctcggcctgggcagcatcaccacgcaggagagcgagtccaacatcctggacatcgacctccgcccggcgagcgcctggaccctgtacgccgtggccaccaccttcgtcacgcccatgctgcggcactccatcgagaacagctccgtgaacgtgagcctcaccgccatcgcgaaccaggccaccgtcctgatggggctgggccgcgggtggcccctctccaagatggacatcggcgtgcccctgctggccatcgggtgctacagccaggtgaacccgatcaccctcacggccgcgctgctgctcctggtcgcccactacgccatcatcggccccggcctgcaggccaaggccacccgcgaggcgcagaagcggaccgccgccgggatcatgaagaaccccaccgtggacggcatcacggtgatcgacctcgagcccatcccgtacgaccccaagttcgagaagcagctggggcaggtcatgctgctcgtgctgtgcgtgacccaggtcctgatgatgcgcaccacctgggccctctgcgaggccctgacgctggcgaccggccccatctccaccctctgggaggggaaccccggccggttctggaacaccacgatcgccgtgagcatggccaacatcttccgcggctcctacctggccggggccggcctcctcttcagcatcatgaagaacaccaccaacacccggcgcgggacgggcaacatcggcgagaccctgggggagaagtggaagtcccggctgaacgcgctcggcaagagcgagttccagatctacaagaagtccgggatccaggaggtggaccgcaccctggccaaggagggcatcaagcgcggggagaccgaccaccacgccgtcagccgcggctccgccaagctgcggtggttcgtggagcgcaacatggtgacgccggagggcaaggtcgtggacctcgggtgcggccgcggcgggtggagctactactgcggcgggctgaagaacgtgcgcgaggtcaaggggctgaccaagggcgggcccgggcacgaggagcccatccccatgtccacctacggctggaacctcgtgcggctgcagagcggggtggacgtcttcttcaccccgcccgagaagtgcgacacgctgctctgcgacatcggcgagagctcccccaaccccaccatcgaggcgggccgcaccctgcgggtgctgaacctcgtggagaactggctgaacaacaacacccagttctgcgtcaaggtgctgaacccgtacatgcccagcgtgatcgagaagatggagaccctccagcgcaagtacgggggcgccctggtccggaaccccctgtcccgcaacagcacgcacgagatgtactgggtgtccaacgccaccgggaacatcgtgagctccgtcaacatgatcagccgcatgctgatcaaccggttcaccatgaagcacaagaaggccacctacgagccggacgtggacctcggctccgggacgcgcaacatcggcatcgagaacgagatccccaacctggacatcatcggcaagcggatcgagaagatcaagcaggagcacgagaccagctggcactacgaccaggaccacccctacaagacctgggcctaccacgggtcctacgagaccaagcagacgggcagcgcgtccagcatggtgaacggggtcgtgaagctgctcaccaagccctgggacgtggtcccgatggtgacccagatggccatgaccgacacgacccccttcggccagcagcgcgtgttcaaggagaaggtcgacacccggacccaggagcccaaggagggcacgaagaagctgatgcgcatcaccgccgagtggctgtggaaggagctcgggaagaagaagacgccccggatgtgcacccgcgaggagttcacgcggaaggtgcgctccaacgccgccctgggcgcgatcttcaccgacgagaacaagtggaagtccgcccgggaggccgtcgaggactcccgcttctgggagctggtggaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtcgagggggagggcctgcacaagctcggctacatcctgcgggacgtgtccaagaaggagggcggggccatgtacgccgacgacaccgcggggtgggacacgcgcatcaccctggaggacctcaagaacgaggagatggtgaccaaccacatgaagggcgagcacaagaagctggccgaggccatcttcaagctgacctaccagaacaaggtcgtgcgggtgcagcgcccgacgccccgcgggaccgtcatggacatcatcagccggaaggaccagcgcggctccggccaggtggggacctacggcctcaacaccttcacgaacatggaggcccagctgatccggcagatggagggggagggcatcttcaagagcatccagcgcctgaccgtgaccgaggagatcgccgtccagaactggctcgcgcgggtgggccgcgagcggctgtcccgcatggccatcagcggggacgactgcgtggtcaagcccctggacgaccggttcgcctccgccctcaccgccctgaacgacatgggcaaggtgcgcaaggacatccagcagtgggagcccagccgggggtggaacgactggacccaggtgccgttctgctcccaccacttccacgagctggtcatgaaggacggccgcgtgctcgtggtcccctgccggaaccaggacgagctgatcgggcgcgcgcggatcagccagggcgccggctggtccctgaaggagaccgcctgcctcggcaagagctacgcccagatgtggaccctgatgtacttccaccgccgggacctgcgcctcgccgcgaacgccatctgctccgccgtgcccagccactgggtgcccacctcccggaccacgtggagcatccacgccaagcacgagtggatgaccaccgaggacatgctggccgtctggaaccgcgtgtggatccaggagaacccgtggatggaggacaagacccccgtggagtcctgggaggaggtcccctacctgggcaagcgcgaggaccagtggtgcgggagcctcatcggcctgacgagccgggcgacctgggccaagaacatccagaccgccatcaaccaggtgcgctccctgatcgggaacgaggagtacaccgactacatgcccagcatgaagcggttccgcaaggaggaggaggaggccggcgtgctctggtga

SEQ ID NO: 9355 - RNA, 9876 nt, synthetic construct
  misc_feature 1..9876: note = derived and/or modified CDS sequence (opt1) from DENV-2__EU482545__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcatgatcacgccccacagcggggaggagcacgccgtgggcaacgacaccgggaagcacggcaaggagatcaagatcaccccgcagtccagcatcaccgaggccgagctgaccgggtacggcacggtcaccatggagtgcagcccccggaccggcctcgacttcaacgagatggtgctgctgcagatggaggacaaggcctggctcgtgcaccggcagtggttcctggacctgcccctcccctggctgccgggggccgacacccagggcagcaactggatccagaaggagacgctggtcaccttcaagaacccccacgcgaagaagcaggacgtggtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctggagaagcggcacgtgctcgggcgcctgatcaccgtcaacccgatcgtgaccgagaaggacagccccgtgaacatcgaggcggagccgcccttcggcgactcctacatcatcatcggggtcgagccgggccagctgaagctcaactggttcaagaaggggagctccatcggccagatgttcgagaccacgatgcgcggcgccaagcggatggccatcctgggggacaccgcctgggacttcggcagcctcgggggcgtgttcacctccgtggggaaggccctccaccaggtcttcggcgcgatctacggcgccgccttcagcggggtgtcctggaccatgaagatcctgatcggcgtgatcatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtcgtggtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcaccaagcacgcgatcctgctcgtggccgtgagcttcgtcacgctgatcaccgggaacatgtccttccgggacctgggccgcgtgatggtgatggtcggggccaccatgaccgacgacatcggcatgggcgtgacgtacctcgccctgctggccgcgttcaaggtgcgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggccctgaagatcgtcaagaacatggagaagtaccagctcgccgtgaccatcatggccatctcctgcgtgccgaacgcggtcatcctgcagaacgcctggaaggtgagctgcacgatcctggccgccgtgtccgtcagccccctcctgctgacctccagccagcagaaggcggactggatccccctcgccctgaccatcaagggcctgaaccccaccgccatcttcctcacgaccctgtcccgcaccagcaagaagcggtcctggccgctgaacgaggccatcatggccgtgggcatggtcagcatcctcgcgtccagcctgctgaagaacgacatccccatgaccgggcccctcgtggccggcgggctgctgacggtgtgctacgtcctcaccggccgcagcgccgacctggagctggagcgggccgccgacgtgaagtgggaggaccaggcggagatctccgggagctcccccatcctcagcatcaccatctccgaggacggcagcatgtccatccgcaacgaggaggaggagcagaccctgacgatcctgatccggaccggcctcctggtgatcagcggggtcttcccggtgtccatccccgtgaccgccgccgcctggtacctgtgggaggtcaagaagcagcgcgccggcgtgctctgggacgtgcccagcccgccgcccgtcgggaaggcggagctggaggacggcgcctaccggatcaagcagcgcgggatcctgggctactcccagatcggcgccggggtgtacaaggagggcaccttccacaccatgtggcacgtgacgcgcggggccgtcctcatgcaccgcggcaagcggatcgagcccagctgggccgacgtgaagaaggacctggtgtcctacgggggcggctggaagctggagggggagtggaaggagggcgaggaggtccaggtgctcgcgctggagcccgggaagaacccccgcgccgtgcagaccaagcccggcatcttcaagaccaacaccgggacgatcggcgccgtcagcctggacttctcccccggcaccagcgggtcccccatcgtggaccggaagggcaaggtggtcgggctctacggcaacggcgtggtgacccgcagcggggcctacgtctccgcgatcgcccagaccgagaagtccatcgaggacaaccccgagatcgaggacgacatcttccggaagaagcgcctgacgatcatggacctgcaccccggcgccgggaagaccaagcggtacctccccgccatcgtgcgcgaggccatcaagcggggcctgcgcaccctgatcctggcgccgacccgcgtggtcgccgccgagatggaggaggccctccgggggctgcccatccgctaccagacgcccgccatccgggcggagcacaccggccgcgagatcgtggacctgatgtgccacgccaccttcaccatgcggctcctgagccccgtgcgcgtcccgaactacaacctgatcatcatggacgaggcccacttcacggaccccgcctccatcgccgcgcggggctacatcagcacccgcgtggagatgggggaggccgccggcatcttcatgaccgccacgccgcccgggtcccgggacccgttcccccagagcaacgcgcccatcatggacgaggagcgcgagatccccgagcggtcctggaacagcggccacgagtgggtgacggacttcaaggggaagaccgtctggttcgtgccgtccatcaaggccggcaacgacatcgccgcctgcctccgcaagaacggcaagaaggtgatccagctgagccggaagaccttcgactccgagtacgtcaagacccgcgccaacgactgggacttcgtggtgacgaccgacatcagcgagatgggggcgaacttcaaggccgagcgggtcatcgacccccgccggtgcatgaagcccgtgatcctgaccgacggcgaggagcgcgtgatcctcgccgggcccatgccggtcacccactccagcgccgcccagcggcgcggccgcatcgggcggaaccccaagaacgagaacgaccagtacatctacatgggcgagcccctggagaacgacgaggactgcgcgcactggaaggaggccaagatgctgctcgacaacatcaacacgcccgagggcatcatcccgtccatgttcgagcccgagcgcgagaaggtggacgccatcgacggggagtaccggctgcgcggcgaggcccggaagaccttcgtggacctgatgcgccgcggggacctccccgtctggctggcctacaaggtggcggccgagggcatcaactacgccgaccgccggtggtgcttcgacgggatcaagaacaaccagatcctggaggagaacgtggaggtcgagatctggaccaaggagggcgagcgcaagaagctcaagccgcggtggctggacgcccgcatctacagcgaccccctggcgctcaaggagttcaaggagttcgccgccggccggaagtccctgaccctgaacctcatcacggagatggggcgcctgcccaccttcatgacccagaaggcccggaacgccctggacaacctcgcggtgctgcacaccgccgaggccggcgggaaggcctacaaccacgccctgagcgagctccccgagacgctggagaccctgctcctgctgaccctcctggcgaccgtcacgggcggcatcttcctgttcctcatgtccgggaagggcatcgggaagatgaccctgggcatgtgctgcatcatcaccgccagcatcctgctctggtacgcccagatccagccgcactggatcgccgcctccatcatcctggagttcttcctgatcgtgctcctgatccccgagcccgagaagcagcgcacgccccaggacaaccagctgacctacgtggtcatcgcgatcctcacggtggtggccgccaccatggccaacgagatggggttcctggagaagaccaagaaggacctgggcctcggcagcatcaccacgcaggagagcgagtccaacatcctggacatcgacctgcggccggccagcgcgtggaccctctacgccgtcgccaccaccttcgtgacgcccatgctgcgccactccatcgagaacagctccgtgaacgtcagcctgaccgccatcgcgaaccaggccaccgtgctcatggggctgggcaaggggtggcccctgtccaagatggacatcggcgtgcccctcctggccatcgggtgctacagccaggtcaacccgatcaccctgacggccgccctcctgctgctcgtggcgcactacgccatcatcggccccggcctgcaggccaaggccacccgggaggcccagaagcgcgcggccgccgggatcatgaagaaccccaccgtggacggcatcaccgtcatcgacctggagcccatcccgtacgaccccaagttcgagaagcagctcgggcaggtcatgctgctgatcctctgcgtgacgcaggtcctgatgatgcggaccacctgggccctgtgcgaggccctcaccctggcgacgggccccatctccaccctgtgggaggggaaccccggccgcttctggaacaccaccatcgccgtgagcatggccaacatcttccgcggctcctacctcgccggggcgggcctgctgttcagcatcatgaagaacacgaccaacacccggcgcgggaccggcaacatcggcgagacgctcggggagaagtggaagtcccggctgaacgccctgggcaagagcgagttccagatctacaagaagtccgggatccaggaggtggaccgcaccctcgccaaggagggcatcaagcgcggggagaccgaccaccacgccgtcagccgcggctccgccaagctgcggtggttcgtggagcgcaacatggtgaccccggagggcaaggtcgtggacctggggtgcggccgcgggggctggagctactactgcgggggcctcaagaacgtgcgcgaggtcaagggcctgacgaagggcggccccgggcacgaggagcccatccccatgtccacctacggctggaacctggtgcggctccagagcggggtggacgtcttcttcaccccgcccgagaagtgcgacaccctgctgtgcgacatcggcgagagctcccccaaccccacgatcgaggcgggccgcaccctccgggtgctgaacctggtggagaactggctcaacaacaacacccagttctgcatcaaggtcctgaacccgtacatgcccagcgtgatcgagaagatggagaccctgcagcgcaagtacgggggcgccctcgtgcggaaccccctgtcccgcaacagcacccacgagatgtactgggtctccaacgccacggggaacatcgtgagctccgtgaacatgatcagccggatgctgatcaaccgcttcaccatgaagcacaagaaggccacctacgagccggacgtcgacctgggctccgggacccggaacatcggcatcgagagcgagatccccaacctcgacatcatcggcaagcgcatcgagaagatcaagcaggagcacgagacgtcctggcactacgaccaggaccacccctacaagacctgggcctaccacgggagctacgagaccaagcagaccggctccgcgagctccatggtgaacggggtggtccgcctgctgacgaagccctgggacgtggtgccgatggtcacccagatggccatgaccgacaccacgcccttcggccagcagcgggtgttcaaggagaaggtggacacccgcacccaggagcccaaggagggcaccaagaagctcatgaagatcacggccgagtggctgtggaaggagctggggaagaagaagacgccccggatgtgcacccgcgaggagttcacccggaaggtccgcagcaacgccgccctcggcgcgatcttcacggacgagaacaagtggaagtccgcccgggaggccgtggaggacgggcgcttctgggagctggtggaccgggagcgcaacctgcacctcgagggcaagtgcgagacctgcgtctacaacatgatggggaagcgggagaagaagctgggcgagttcggcaaggccaaggggagccgcgcgatctggtacatgtggctgggcgcccggttcctcgagttcgaggccctggggttcctgaacgaggaccactggttctcccgcggcaacagcctcagcggggtggagggcgagggcctgcaccggctggggtacatcctccgcgacgtctccaagaaggagggcggggccatgtacgccgacgacaccgcgggctgggacacccggatcacgctggaggacctgaagaacgaggagatggtgaccaaccacatgaagggggagcacaagaagctcgccgaggccatcttcaagctgacctaccagaacaaggtggtccgcgtgcagcggccgacgccccggggcacggtgatggacatcatcagccggcgcgaccagcgcggctccgggcaggtcggcacctacgggctgaacaccttcaccaacatggaggcccagctcatccggcagatggagggcgagggcatcttcaagagcatccagcacctgacggtgaccgaggagatcgccgtgcagaactggctggcgcgcgtcgggcgggagcgcctctcccggatggccatcagcggcgacgactgcgtggtgaagcccatcgacgaccgcttcgcctccgccctgaccgccctgaacgacatggggaaggtccggaaggacatccagcagtgggagcccagccgcggctggaacgactggacccaggtgccgttctgctcccaccacttccacgagctcgtgatgaaggacgggcgggtcctggtggtgccctgccgcaaccaggacgagctgatcggccgggcgcgcatcagccagggcgccgggtggtccctcaaggagacggcctgcctgggcaagagctacgcccagatgtggaccctgatgtacttccaccggcgcgacctccggctggccgcgaacgccatctgctccgccgtccccagccactgggtgcccacctcccgcaccacctggagcatccacgccaagcacgagtggatgacgaccgaggacatgctggcggtgtggaaccgggtctggatccaggagaacccgtggatggaggacaagacccccgtggagtcctgggaggaggtgccctacctcgggaagcgcgaggaccagtggtgcggcagcctgatcgggctgaccagccgggccacgtgggccaagaacatccagaccgccatcaaccaggtccgctccctcatcggcaacgaggagtacaccgactacatgcccagcatgaagcgcttccggcgcgaggaggaggaggccggcgtgctgtggtga

SEQ ID NO: 9356 - RNA, 9876 nt, synthetic construct
  misc_feature 1..9876: note = derived and/or modified CDS sequence (opt1) from DENV-2__EU482546__SS-prME
  source 1..9876: mol_type = other RNA
accgccggcgtcatcgtcatgctgatccccaccgtgatggccttccacctcaccacccgcaacggggagccccacatgatcgtgggccggcaggagaaggggaagtccctgctgttcaagaccgaggacggcatcaacatgtgcaccctcatggcgatcgacctgggggagctgtgcgaggacaccatcacctacaagtgccccctcctgaagcagaacgagcccgaggacatcgactgctggtgcaacagcaccagcacctgggtcacctacgggacctgcaccaccacgggcgagcaccgccgggagaagcgctccgtggccctggtgccccacgtcgggatgggcctcgagacccggaccgagacctggatgagctccgagggggcctggaagcacgtgcagcgcatcgagacgtggatcctgcggcacccgggcttcaccatcatggccgccatcctggcgtacaccatcgggaccacgcacttccagcgcgccctcatcttcatcctgctgaccgccgtggcccccagcatgaccatgcggtgcatcggcatctccaaccgcgacttcgtcgagggcgtgagcgggggctcctgggtggacatcgtcctcgagcacgggagctgcgtgaccacgatggcgaagaacaagcccaccctggacttcgagctgatcaagaccgaggccaagcagcccgccaccctccggaagtactgcatcgaggccaagctgacgaacaccaccaccgagtcccgctgcccgacgcagggcgagcccagcctgaacgaggagcaggacaagcggttcatctgcaagcactccatggtggaccgcggctgggggaacggctgcgggctgttcggcaagggcgggatcgtgacctgcgccatgttcacgtgcaagaagaacatggagggcaaggtggtgcagcccgagaacctggagtacaccatcgtcatcacgccccacagcggggaggagcacgcggtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccgccagtggttcctggacctgcccctcccctggctgccgggggccgacacccagggcagcaactggatccagaaggagacgctggtgaccttcaagaacccccacgccaagaagcaggacgtcgtggtcctcgggtcccaggagggcgcgatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccgagaaggacagccccgtgaacatcgaggccgagccgcccttcggcgactcctacatcatcatcggggtggagccgggccagctgaagctcaactggttcaagaaggggagctccatcggccagatgttcgagacgaccatgcgcggcgcgaagcgcatggccatcctgggggacaccgcctgggacttcggcagcctcggcggggtcttcacctccatcgggaaggccctccaccaggtgttcggggccatctacggcgcggccttcagcggggtgtcctggacgatgaagatcctgatcggcgtcatcatcacctggatcgggatgaacagccggtccaccagcctgtccgtgagcctggtgctcgtcggcgtggtgaccctgtacctgggggccatggtccaggccgactccggctgcgtggtgagctggaagaacaaggagctcaagtgcggctccgggatcttcatcacggacaacgtccacacctggaccgagcagtacaagttccagcccgagagccccagcaagctggcgtccgccatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggccaagatgctcagcaccgagtcccacaaccagaccttcctgatcgacgggcccgagaccgcggagtgcccgaacacgaaccgcgcctggaacagcctggaggtcgaggactacggcttcggggtgttcaccaccaacatctggctcaagctgcgggagaagcaggacgccttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaaccaccggccgggctaccacacgcagaccgcggggccctggcacctcggcaagctggagatggacttcgacttctgcgaggggaccaccgtcgtggtgacggaggactgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtcaacagcctggtgaccgccgggcacggccagatcgacaacttctccctcggcgtgctggggatggccctgttcctcgaggagatgctgcgcacccgggtcggcacgaagcacgcgatcctgctcgtggccgtgagcttcgtcaccctgatcaccgggaacatgtccttccgcgacctgggccgggtgatggtgatggtcggggccaccatgacggacgacatcggcatgggcgtgacctacctcgccctgctggccgcgttcaaggtgcgccccaccttcgccgccgggctcctgctgcgcaagctcaccagcaaggagctgatgatggccacgatcggcatcgccctgctctcccagagcaccatccccgagaccatcctggagctgaccgacgcgctcgccctggggatgatggtcctgaagatcgtgcggaacatggagaagtaccagctcgccgtgacgatcatggccatctcctgcgtcccgaacgccgtgatcctgcagaacgcgtggaaggtgagctgcaccatcctggccgccgtctccgtgagccccctcctgctgacctccagccagcagaaggccgactggatccccctcgcgctgaccatcaagggcctgaaccccacggccatcttcctcaccaccctgtcccgcaccagcaagaagcggtcctggccgctgaacgaggccatcatggccgtcggcatggtgagcatcctcgcctccagcctgctgaagaacgacatccccatgacggggcccctcgtggcgggcgggctgctgaccgtctgctacgtgctcaccggccgcagcgccgacctggagctggagcgggccgccgacgtgaagtgggaggaccaggccgagatctccgggagctcccccatcctcagcatcaccatctccgaggacggcagcatgtccatcaagaacgaggaggaggagcagacgctgaccatcctgatccgcaccggcctcctggtcatcagcggggtgttcccggtgtccatccccatcaccgcggccgcctggtacctgtgggaggtcaagaagcagcgggccggcgtgctctgggacgtgcccagcccgccgcccgtcgggaaggccgagctggaggacggcgcgtaccgcatcaagcagcgggggttcctgggctactcccagatcggcgccggggtgtacaaggagggcaccttccacacgatgtggcacgtgacccgcggggccgtcctcatgcaccggggcaagcgcatcgagcccagctgggccgacgtgaagaaggacctgatctcctacgggggcggctggaagctggagggggagtggaaggagggcgaggaggtgcaggtcctcgccctggagcccgggaagaacccccgggcggtgcagaccaagcccggcatcttcaagaccaacacggggaccatcggcgccgtgagcctggacttctcccccggcaccagcgggtcccccatcgtcgaccgcaagggcaaggtggtggggctctacggcaacggcgtcgtgacccggagcggggcctacgtgtccgccatcgcgcagacggagaagtccatcgaggacaaccccgagatcgaggacgacatcttccgcaagaagcggctgaccatcatggacctgcaccccggcgccgggaagaccaagcgctacctccccgccatcgtccgggaggccatcaagcgcggcctgcggaccctgatcctggccccgacgcgcgtggtggcggccgagatggaggaggccctccgcgggctgcccatccggtaccagacccccgccatccgcgccgagcacaccggccgggagatcgtcgacctgatgtgccacgcgaccttcacgatgcgcctcctgagccccgtgcgggtgccgaactacaacctgatcatcatggacgaggcccacttcaccgaccccgcctccatcgccgcccgcggctacatcagcacccgggtcgagatgggggaggcggccggcatcttcatgaccgccacgccgcccgggtcccgcgacccgttcccccagagcaacgcccccatcatggacgaggagcgggagatccccgagcgctcctggaacagcggccacgagtgggtgaccgacttcaaggggaagaccgtgtggttcgtcccgtccatcaaggcgggcaacgacatcgccgcctgcctccggaagaacggcaagaaggtgatccagctgagccgcaagaccttcgactccgagtacgtgaagacgcgggccaacgactgggacttcgtcgtgaccaccgacatcagcgagatgggggccaacttcaaggcggagcgcgtgatcgacccccggcgctgcatgaagcccgtcatcctgaccgacggcgaggagcgggtgatcctcgccgggcccatgccggtgacgcactccagcgccgcccagcgccggggccgcatcgggcgcaaccccaagaacgagaacgaccagtacatctacatgggcgagcccctggagaacgacgaggactgcgcccactggaaggaggcgaagatgctgctcgacaacatcaacacccccgagggcatcatcccgtccatgttcgagcccgagcgggagaaggtcgacgccatcgacggggagtaccgcctgcggggcgaggcccgcaagaccttcgtggacctgatgcggcgcggggacctccccgtgtggctggcctacaaggtcgccgcggagggcatcaactacgccgaccggaagtggtgcttcgacgggatcaagaacaaccagatcctggaggagaacgtggaggtggagatctggaccaaggagggcgagcgcaagaagctcaagccgcggtggctggacgcccgcatctacagcgaccccctggccctcaaggagttcaaggagttcgcggccggccggaagtccctgacgctgaacctcatcaccgagatggggcgcctgcccaccttcatgacccagaaggcccggaacgccctggacaacctcgccgtcctgcacacggcggaggccggcgggcgcgcctacaaccacgccctgagcgagctccccgagaccctggagaccctgctcctgctgaccctcctggccacggtgaccggcggcatcttcctgttcctcatgtccgggaagggcatcgggaagatgaccctgggcatgtgctgcatcatcaccgcgagcatcctgctctggtacgcccagatccagccgcactggatcgccgcctccatcatcctggagttcttcctgatcgtcctcctgatccccgagcccgagaagcagcggacgccccaggacaaccagctgacgtacgtggtgatcgccatcctcaccgtcgtggcggccaccatggccaacgagatggggttcctggagaagaccaagaaggacctgggcctcggcagcatcacgacccaggagagcgagtccaacatcctggacatcgacctgcgcccggccagcgcctggaccctctacgcggtggccaccacgttcgtcacccccatgctgcggcactccatcgagaacagctccgtgaacgtgagcctgaccgccatcgccaaccaggcgaccgtcctcatggggctgggcaaggggtggcccctgtccaagatggacatcggcgtgcccctcctggccatcgggtgctacagccaggtgaacccgatcacgctgaccgccgccctcctgctgctcgtcgcccactacgcgatcatcggccccggcctgcaggccaaggccacccgcgaggcccagaagcgggccgcggccgggatcatgaagaaccccaccgtggacggcatcacggtgatcgacctggagcccatcccgtacgaccccaagttcgagaagcagctcgggcaggtcatgctgctgatcctctgcgtgacccaggtgctgatgatgcgcaccacctgggccctgtgcgaggccctcacgctggccaccggccccatctccaccctgtgggaggggaaccccggccggttctggaacaccacgatcgcggtcagcatggccaacatcttccgcggctcctacctcgccggggccggcctgctgttcagcatcatgaagaacaccaccaacacccgccgggggacgggcaacatcggcgagaccctcggggagaagtggaagtcccgcctgaacgcgctgggcaagagcgagttccagatctacaagaagtccgggatccaggaggtggaccggaccctcgccaaggagggcatcaagcgcggggagaccgaccaccacgccgtgagccggggctccgccaagctgcgctggttcgtcgagcggaacatggtgacgccggagggcaaggtggtcgacctggggtgcggccgcgggggctggagctactactgcgggggcctcaagaacgtgcgggaggtgaagggcctgaccaagggcggccccgggcacgaggagcccatccccatgtccacctacggctggaacctggtccgcctccagagcggggtggacgtgttcttcaccccgcccgagaagtgcgacacgctgctgtgcgacatcggcgagagctcccccaaccccaccatcgaggccggccggaccctccgcgtcctgaacctggtggagaactggctcaacaacaacacccagttctgcatcaaggtgctgaacccgtacatgcccagcgtcatcgagaagatggagaccctgcagcggaagtacgggggcgcgctcgtgcgcaaccccctgtcccggaacagcacgcacgagatgtactgggtgtccaacgccaccgggaacatcgtcagctccgtgaacatgatcagccgcatgctgatcaaccggttcaccatgaagcacaagaaggccacctacgagccggacgtggacctgggctccgggacgcgcaacatcggcatcgagagcgagatccccaacctcgacatcatcggcaagcggatcgagaagatcaagcaggagcacgagacctcctggcactacgaccaggaccacccctacaagacctgggcctaccacgggagctacgagaccaagcagacgggctccgccagctccatggtcaacggggtggtgcgcctgctgaccaagccctgggacgtcgtgccgatggtgacccagatggcgatgaccgacacgacccccttcggccagcagcgcgtcttcaaggagaaggtggacacccggacccaggagcccaaggagggcacgaagaagctcatgaagatcaccgccgagtggctgtggaaggagctggggaagaagaagacgccccgcgtgtgcacccgggaggagttcacgcgcaaggtccggagcaacgccgccctcggcgccatcttcaccgacgagaacaagtggaagtccgcgcgcgaggccgtggaggacgggcggttctgggagctggtggaccgcgagcggaacctgcacctcgagggcaagtgcgagacctgcgtctacaacatgatggggaagcgcgagaagaagctgggcgagttcggcaaggccaaggggagccgggccatctggtacatgtggctgggcgcgcgcttcctcgagttcgaggccctggggttcctgaacgaggaccactggttctcccggggcaacagcctcagcggggtggagggcgagggcctgcaccgcctggggtacatcctccgggacgtcggcaagaaggagggcggcgccatgtacgccgacgacaccgccgggtgggacacgcgcatcaccctggaggacctgaagaacgaggagatggtgaccaaccacatgaagggcgagcacaagaagctcgcggaggccatcttcaagctgacctaccagaacaaggtggtccgggtgcagcgcccgacgccccggggcaccgtgatggacatcatctcccgccgggaccagcgcgggagcggccaggtcgggacctacggcctgaacaccttcacgaacatggaggcccagctcatccgccagatggagggcgaggggatcttcaagtccatccagcacctgaccgccaccgaggagatcgccgtgcagaactggctggcgcgggtgggccgcgagcggctcagccgcatggccatctccggggacgactgcgtcgtgaagcccatcgacgaccggttcgccagcgccctgaccgccctgaacgacatgggcaaggtgcgcaaggacatccagcagtgggagccctcccgggggtggaacgactggacgcaggtcccgttctgcagccaccacttccacgagctcgtgatgaaggacggccgcgtgctggtcgtgccctgccggaaccaggacgagctgatcggccgcgcgcggatctcccagggggccggctggagcctcaaggagaccgcctgcctggggaagtcctacgcccagatgtggaccctgatgtacttccaccgccgggacctccgcctggccgcgaacgccatctgcagcgccgtgccctcccactgggtccccaccagccggaccacgtggtccatccacgccaagcacgagtggatgaccaccgaggacatgctggcggtgtggaaccgcgtgtggatccaggagaacccgtggatggaggacaagacccccgtcgagagctgggaggaggtgccctacctcggcaagcgggaggaccagtggtgcgggtccctgatcggcctgacgagccgcgccacctgggccaagaacatccagaccgccatcagccaggtgcggtccctcatcggcaacgaggagtacaccgactacatgcccagcatgaagcgcttccgccgggaggaggaggaggccggggtcctgtggtga

SEQ ID NO: 9357 - RNA, 9876 nt, synthetic construct
  misc_feature 1..9876: note = derived and/or modified CDS sequence (opt1) from DENV-2__EU482550__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggtacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcctgtgcgtgccgaacgccgtgatcctccagaacgcctggaaggtcagctgcaccatcctggcggccgtgtccgtcagccccctgctcctgacgtccagccagcagaaggccgactggatccccctggccctcaccatcaagggcctgaaccccaccgcgatcttcctgaccacgctctcccggaccagcaagaagcgctcctggccgctgaacgaggccgtgatggccgtgggcatggtcagcatcctggcctccagcctcctgaagaacgacatccccatgaccgggcccctggtggccggcgggctcctgaccgtgtgctacgtcctgacgggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagaccctcaccatcctgatccggacgggcctgctcgtgatcagcggggtcttcccggtgtccatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctactcccagatcggcgcgggggtctacaaggagggcaccttccacaccatgtggcacgtgacccgcggggccgtgctgatgcaccgcggcaagcggatcgagcccagctgggccgacgtcaagaaggacctgatctcctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgcggtgagcctggacttctcccccggcacgagcgggtcccccatcgtggaccggaagggcaaggtcgtggggctgtacggcaacggcgtggtcacccgcagcggggcctacgtgtccgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtcgtggccgcggagatggaggaggccctgcgggggctccccatccgctaccagacccccgccatccgggccgagcacacgggccgcgagatcgtggacctgatgtgccacgccaccttcaccatgcggctgctcagccccgtccgcgtgccgaactacaacctgatcatcatggacgaggcgcacttcaccgaccccgcctccatcgccgcccggggctacatcagcacgcgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtcaccgacttcaaggggaagacggtgtggttcgtgccgtccatcaaggccggcaacgacatcgcggcctgcctgcgcaagaacggcaagaaggtcatccagctcagccggaagaccttcgactccgagtacgtgaagacccgcgccaacgactgggacttcgtggtcaccacggacatcagcgagatgggggccaacttccgggccgagcgcgtgatcgacccccggcgctgcatgaagcccgtgatcctgaccgacggcgaggagcgggtcatcctggcggggcccatgccggtgacccactccagcgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtggacgcgatcgacggggagtaccgcctccggggcgaggcccgcaagacgttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggaccaaggagggcgagcgcaagaagctgaagccgcggtggctcgacgcccgcatctacagcgaccccctggccctgaaggagttcaaggagttcgccgcgggccggaagtccctcaccctgaacctgatcaccgagatggggcgcctccccacgttcatgacccagaaggcccgggacgccctggacaacctggccgtcctccacaccgccgaggtgggcgggcgcgcgtacaaccacgccctgagcgagctgcccgagaccctcgagacgctgctgctcctgaccctgctcgccaccgtgaccggcggcatcttcctgttcctgatgtccgggaagggcatcgggaagatgacgctcggcatgtgctgcatcatcaccgccagcatcctgctgtggtacgcccagatccagccgcactggatcgcggcctccatcatcctcgagttcttcctgatcgtcctgctcatccccgagcccgagaagcagcggacgccccaggacaaccagctgacctacgtggtgatcgccatcctgaccgtcgtggccgccacgatggcgaacgagatggggttcctcgagaagaccaagaaggacctgggcctgggcagcatcatcacccaggagagcgagtccaacatcctcgacatcgacctgcgcccggccagcgcctggaccctgtacgccgtggccacgaccttcgtcacccccatgctccggcactccatcgagaacagctccgtgaacgtgagcctgaccgcgatcgccaaccaggccacggtcctgatggggctcggccgcgggtggcccctgtccaagatggacatcggcgtgcccctgctcgccatcgggtgctacagccaggtgaacccgatcaccctgaccgcggccctgctcctgctggtcgcccactacgccatcatcggccccggcctccaggccaaggcgacccgcgaggcccagaagcgggccgccgccgggatcatgaagaaccccacggtggacggcatcaccgtgatcgacctggagcccatcccgtacgaccccaagttcgagaagcagctggggcaggtcatgctcctggtgctgtgcgtgacccaggtcctcatgatgcgcaccacgtgggcgctgtgcgaggccctgaccctcgccaccggccccatctccaccctgtgggaggggaaccccggccggttctggaacacgaccatcgccgtgagcatggccaacatcttccgcggctcctacctggcgggggccggcctcctgttcagcatcatgaagaacaccaccaacacgcggcgcgggaccggcaacatcggcgagaccctgggggagaagtggaagtcccggctcaacgccctgggcaagagcgagttccagatctacaagaagtccgggatccaggaggtggaccgcaccctggccaaggagggcatcaagcgcggggagacggaccaccacgcggtcagccgcggctccgccaagctccggtggttcgtggagcgcaacatggtgaccccggagggcaaggtcgtggacctggggtgcggccgcggcgggtggagctactactgcggcgggctgaagaacgtgcgcgaggtcaaggggctcaccaagggcgggcccgggcacgaggagcccatccccatgtccacctacggctggaacctggtgcggctgcagagcggggtggacgtcttcttcacgccgcccgagaagtgcgacaccctcctgtgcgacatcggcgagagctcccccaaccccaccatcgaggccggccgcaccctgcgggtgctcaacctggtggagaactggctgaacaacaacacgcagttctgcatcaaggtcctcaacccgtacatgcccagcgtgatcgagaagatggagaccctgcagcgcaagtacgggggcgccctggtgcggaaccccctgtcccgcaacagcacccacgagatgtactgggtctccaacgccaccgggaacatcgtgagctccgtgaacatgatcagccgcatgctcatcaaccggttcaccatgaagcacaagaaggcgacgtacgagccggacgtcgacctgggctccgggacccgcaacatcggcatcgagaacgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcctccagcatggtgaacggggtggtcaagctcctgaccaagccctgggacgtggtgccgatggtcacccagatggccatgacggacaccacccccttcggccagcagcgcgtgttcaaggagaaggtggacacccggacgcaggagcccaaggagggcaccaagaagctgatgcgcatcaccgccgagtggctctggaaggagctggggaagaagaagacgccccggatgtgcacgcgcgaggagttcacccggaaggtccgctccaacgcggccctgggcgccatcttcaccgacgagaacaagtggaagtccgcccgggaggccgtggaggactcccgcttctgggagctcgtcgaccgggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgggaacagcctgagcggcgtggagggggagggcctccacaagctgggctacatcctgcgggacgtctccaagaaggagggcggcgcgatgtacgccgacgacacggccgggtgggacacccgcatcaccctcgaggacctgaagaacgaggagatggtgaccaaccacatgaagggcgagcacaagaagctggccgaggccatcttcaagctcacgtaccagaacaaggtggtccgggtgcagcgcccgacgccccgggggaccgtgatggacatcatcagccggaaggaccagcgcggctccggccaggtcgggacctacggcctgaacacgttcaccaacatggaggcgcagctgatccggcagatggagggggagggcatcttcaagagcatccagcacctcaccgtgaccgaggagatcgccgtgcagaactggctggcccgcgtcggccgggagcgcctgtcccggatggccatcagcggggacgactgcgtggtgaagcccctcgacgaccgcttcgcctccgcgctgacggccctgaacgacatgggcaaggtccggaaggacatccagcagtgggagcccagccgcgggtggaacgactggacccaggtgccgttctgctcccaccacttccacgagctcgtgatgaaggacggccgggtcctggtggtgccctgccgcagccaggacgagctgatcgggcgggcccgcatctcccagggcgccggctggagcctcaaggagaccgcctgcctggggaagtcctacgcgcagatgtggaccctgatgtacttccaccggcgcgacctccggctggccgccaacgccatctgcagcgccgtcccctcccactgggtgcccacgagccgcaccacctggtccatccacgcgaagcacgagtggatgaccaccgaggacatgctggccgtgtggaaccgggtctggatccaggagaacccgtggatggaggacaagacgctcgtggagagctgggaggaggtgccctacctgggcaagcgcgaggaccagtggtgcgggagcctgatcggcctcacctcccgcgccacctgggccaagaacatccagaccgcgatcaaccaggtccggagcctgatcgggaacgaggagtacacggactacatgccctccatgaagcgcttccggaaggaggaggaggaggccggcgtgctgtggtga

SEQ ID NO: 9358 - RNA, 9876 nt, synthetic construct
  misc_feature 1..9876: note = derived and/or modified CDS sequence (opt1) from DENV-2__EU482551__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccaccatggccgcgatcctggcctacaccatcgggaccacccacttccagcgggtgctcatcttcatcctgctgaccgccgtggcccccagcatgaccatgcgctgcatcggcatctccaaccgggacttcgtcgagggcgtgagcgggggctcctgggtggacatcgtcctcgagcacgggagctgcgtgacgaccatggcgaagaacaagcccaccctggacttcgagctgatcaagaccgaggccaagcagcccgccacgctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcggcctgttcggcaagggcgggatcgtgacctgcgccatgttcacgtgcaagaagaacatggagggcaaggtggtgctgcccgagaacctggagtacacgatcgtcatcacgccccacagcggggaggagcacgcggtgggcaacgacaccgggaagcacggcaaggagatcaagatcaccccgcagtccagcatcaccgaggccgagctcacggggtacggcaccgtgaccatggagtgcagcccccggaccggcctggacttcaacgagatggtcctgctccagatggaggacaaggcctggctggtgcaccggcagtggttcctggacctccccctgccctggctgccgggggccgacacgcagggcagcaactggatccagaaggagaccctcgtgaccttcaagaacccccacgccaagaagcaggacgtcgtggtcctggggtcccaggagggcgcgatgcacaccgccctgacgggggccaccgagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacgcagcacgggaccatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggccgagccgcccttcggcgactcctacatcatcatcggggtggagccgggccagctcaagctgaactggttcaagaaggggagctccatcggccagatgttcgagacgaccatgcgcggcgcgaagcggatggccatcctgggggacaccgcctgggacttcggcagcctcgggggcgtcttcacctccatcgggaaggccctgcaccaggtgttcggcgccatctacggcgcggccttcagcggggtgtcctggacgatgaagatcctgatcggcgtcatcatcacctggatcgggatgaacagccgctccaccagcctgtccgtgagcctcgtgctggtcggcatcgtgaccctgtacctcggggtgatggtccaggccgacacgggctgcgtggtgtcctggaagaacaaggagctgaagtgcggcagcgggatcttcatcaccgacaacgtccacacctggaccgagcagtacaagttccagcccgagtcccccagcaagctggccagcgcgatccagaaggcccacgaggagggcatctgcgggatccggtccgtgacgcgcctcgagaacctgatgtggaagcagatcacccccgagctgaaccacatcctcagcgagaacgaggtgaagctgaccatcatgaccggcgacatcaaggggatcatgcaggccggcaagcggtccctgcgcccgcagcccacggagctcaagtacagctggaagacctggggcaaggccaagatgctgtccaccgagagccacaaccagaccttcctgatcgacgggcccgagacggccgagtgcccgaacaccaaccgggcgtggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgccgacatgggctactggatcgagtccgcgctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacgcagaccgccgggccctggcacctgggcaagctggagatggacttcgacttctgcgaggggaccaccgtcgtggtgacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgcggggcacggccagatcgacaacttctccctgggcgtgctggggatggccctcttcctggaggagatgctgcggacccgcgtcggcacgaagcacgccatcctcctggtggccgtgagcttcgtcaccctgatcaccgggaacatgtccttccgggacctcggccgcgtgatggtgatggtcggggcgaccatgacggacgacatcggcatgggcgtgacctacctggccctgctcgccgccttcaaggtgcgccccaccttcgccgcggggctgctgctccggaagctgaccagcaaggagctgatgatggccacgatcggcatcgccctcctgtcccagagcaccatccccgagaccatcctggagctcaccgacgccctggccctggggatgatggtcctcaagatcgtgcgcaacatggagaagtaccagctggcggtgacgatcatggccatctcctgcgtcccgaacgccgtgatcctgcagaacgcctggaaggtgagctgcaccatcctcgccgcggtctccgtgagccccctgctgctcacctccagccagcagaaggccgactggatccccctggccctgaccatcaagggcctcaaccccacggccatcttcctgaccaccctgtcccggaccagcaagaagcgctcctggccgctcaacgaggcggtcatggccgtgggcatggtgagcatcctggcctccagcctgctcaagaacgacatccccatgacggggcccctggtcgccggcgggctgctcaccgtgtgctacgtgctgaccggccggagcgccgacctggagctcgagaaggcggccgacgtcaagtgggaggaccaggccgagatctccgggagctcccccatcctgagcatcaccatctccgaggacggcagcatgtccatcaagaacgaggaggaggagcacacgctgaccatcctcatccgcaccggcctgctggtgatcagcggggtgttcccggtctccatccccatcaccgccgccgcgtggtacctctgggaggtgaagaagcagcgggccggcgtgctgtgggacgtccccagcccgccgcccgtggggaaggccgagctggaggacggcgcctaccgcatcaagcagcgggggatcttcggctactcccagatcggcgccggggtgtacaaggagggcaccttccacacgatgtggcacgtcacccgcggggcggtgctcatgcaccggggcaagcgcatcgagcccagctgggccgacgtgaagaaggacctgatctcctacgggggcggctggaagctggagggggagtggaaggagggcgaggaggtccaggtgctcgccctggagcccgggaagaacccccgggccgtgcagaccaagcccggcctgttcaagaccaacacggggaccatcggcgccgtcagcctcgacttctcccccggcaccagcgggtcccccatcgtggaccgcaagggcaaggtggtcgggctgtacggcaacggcgtggtgacccggagcggggcgtacgtctccgccatcgcccagacggagaagtccatcgaggacaaccccgagatcgaggacgacatcttccgcaagaagcggctgaccatcatggacctccaccccggcgccgggaagaccaagcgctacctgcccgcgatcgtgcgggaggccatcaagcgcggcctgcggaccctgatcctcgccccgacgcgcgtggtcgccgccgagatggaggaggcgctgcgcgggctgcccatccggtaccagacccccgccatccgcgccgagcacaccggccgggagatcgtggacctcatgtgccacgccaccttcacgatgcgcctgctgagccccgtgcgggtcccgaactacaacctcatcatcatggacgaggcccacttcaccgaccccgcgtccatcgccgcccgcggctacatcagcacccgggtggagatgggggaggccgccggcatcttcatgaccgcgacgccgcccgggtcccgcgacccgttcccccagagcaacgcccccatcatggacgaggagcgggagatccccgagcgctcctggaacagcggccacgagtgggtgaccgacttcaaggggaagaccgtctggttcgtgccgtccatcaaggccggcaacgacatcgccgcgtgcctgcggaagaacggcaagaaggtgatccagctgagccgcaagaccttcgactccgagtacgtcaagacgcgggccaacgactgggacttcgtggtgaccaccgacatcagcgagatgggggccaacttccgcgccgagcgggtcatcgacccccgccggtgcatgaagcccgtgatcctcaccgacggcgaggagcgcgtgatcctggccgggcccatgccggtcacgcactccagcgcggcccagcggcgcggccgcatcgggcggaaccccaagaacgagaacgaccagtacatctacatgggcgagcccctggagaacgacgaggactgcgcccactggaaggaggccaagatgctcctggacaacatcaacacccccgagggcatcatcccgtccatgttcgagcccgagcgcgagaaggtggacgccatcgacggggagtaccggctgcgcggcgaggcgcggaagaccttcgtggacctcatgcgccgcggggacctgcccgtctggctggcctaccgcgtggccgccgagggcatcaactacgccgaccggcgctggtgcttcgacgggatcaagaacaaccagatcctcgaggagaacgtggaggtcgagatctggaccaaggagggcgagcggaagaagctgaagccgcgctggctggacgcgcggatctacagcgaccccctcgccctgaaggagttcaaggagttcgccgccggccgcaagtccctgacgctcaacctgatcaccgagatggggcggctgcccaccttcatgacccagaaggcgcgcgacgccctcgacaacctggccgtgctgcacacggccgaggtcggcgggcgggcctacaaccacgcgctcagcgagctgcccgagaccctggagaccctcctgctgctcaccctgctggccacggtgaccggcggcatcttcctcttcctgatgtccgggaagggcatcgggaagatgaccctgggcatgtgctgcatcatcaccgccagcatcctcctgtggtacgcccagatccagccgcactggatcgccgcgtccatcatcctggagttcttcctcatcgtgctgctgatccccgagcccgagaagcagcgcacgccccaggacaaccagctcacgtacgtcgtgatcgccatcctgaccgtggtcgccgccaccatggccaacgagatggggttcctggagaagaccaagaaggacctcggcctgggcagcatcacgacccaggagagcgagtccaacatcctggacatcgacctccggccggcgagcgcctggaccctgtacgccgtggccaccacgttcgtgacccccatgctgcgccactccatcgagaacagctccgtcaacgtgagcctcaccgccatcgcgaaccaggccaccgtgctgatggggctgggccgggggtggcccctctccaagatggacatcggcgtccccctgctggccatcgggtgctacagccaggtgaacccgatcacgctcaccgccgcgctgctgctcctggtggcccactacgccatcatcggccccggcctgcaggccaaggccacccgcgaggcgcagaagcgcaccgccgccgggatcatgaagaaccccacggtcgacggcatcaccgtgatcgacctcgagcccatcccgtacgaccccaagttcgagaagcagctggggcaggtcatgctgctcgtcctgtgcgtgacccaggtgctgatgatgcggaccacgtgggccctctgcgaggccctgaccctggcgaccggccccatctccaccctctgggaggggaaccccggccgcttctggaacacgaccatcgccgtcagcatggccaacatcttccggggctcctacctggccggggccggcctcctcttcagcatcatgaagaacaccaccaacacgcgccgggggaccggcaacatcggcgagaccctgggggagaagtggaagtcccgcctgaacgcgctcggcaagagcgagttccagatctacaagaagtccgggatccaggaggtggaccggaccctggccaaggagggcatcaagcgcggggagacggaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgaccaagggcgggcccgggcacgaggagcccatccccatgtccacctacggctggaacctcgtccgcctgcagagcggggtggacgtgttcttcacgccgcccgagaagtgcgacaccctgctctgcgacatcggcgagagctcccccaaccccaccatcgaggcgggccggaccctgcgcgtcctgaacctcgtggagaactggctgaacaacaacacccagttctgcgtgaaggtcctgaacccgtacatgcccagcgtgatcgagaagatggagacgctccagcggaagtacgggggcgccctggtgcgcaaccccctgtcccggaacagcacccacgagatgtactgggtctccaacgccaccgggaacatcgtgagctccgtgaacatgatcagccgcatgctgatcaaccgcttcaccatgaagcacaagaaggccacgtacgagccggacgtcgacctcggctccgggacccggaacatcggcatcgagaacgagatccccaacctggacatcatcggcaagcgcatcgagaagatcaagcaggagcacgagaccagctggcactacgaccaggaccacccctacaagacctgggcctaccacgggtcctacgagacgaagcagaccggcagcgcgtccagcatggtgaacggggtggtcaagctgctcaccaagccctgggacgtggtgccgatggtcacccagatggccatgacggacaccacccccttcggccagcagcgggtgttcaaggagaaggtggacacccgcacgcaggagcccaaggagggcaccaagaagctgatgcggatcaccgccgagtggctgtggaaggagctcgggaagaagaagacgccccgcatgtgcacgcgggaggagttcacccgcaaggtccggtccaacgccgccctgggcgcgatcttcaccgacgagaacaagtggaagtccgcccgcgaggccgtggaggactcccggttctgggagctggtcgaccgcgagcggaacctccacctggaggggaagtgcgagacctgcgtgtacaacatgatgggcaagcgcgagaagaagctgggggagttcggcaaggccaagggcagccgggccatctggtacatgtggctcggggcgcgcttcctggagttcgaggccctgggcttcctcaacgaggaccactggttctcccgggggaacagcctgagcggcgtggagggggagggcctgcacaagctcggctacatcctgcgcgacgtctccaagaaggagggcggggccatgtacgccgacgacacggcggggtgggacacccggatcaccctggaggacctcaagaacgaggagatggtgaccaaccacatgaagggcgagcacaagaagctggccgaggccatcttcaagctgacgtaccagaacaaggtggtccgcgtgcagcggccgacgccccgcgggaccgtgatggacatcatcagccgcaaggaccagcggggctccggccaggtcgggacctacggcctcaacacgttcaccaacatggaggcccagctgatccgccagatggagggggagggcatcttcaagagcatccagcggctgaccgtgaccgaggagatcgccgtgcagaactggctcgcgcgcgtcggccgggagcgcctgtcccggatggccatcagcggggacgactgcgtggtgaagcccctggacgaccgcttcgcctccgccctcacggccctgaacgacatgggcaaggtccggaaggacatccagcagtgggagcccagccgcgggtggaacgactggacccaggtgccgttctgctcccaccacttccacgagctggtgatgaaggacggccggatgctcgtcgtgccctgccgcaaccaggacgagctgatcgggcgggcgcgcatcagccagggcgccggctggtccctgaaggagaccgcctgcctcggcaagagctacgcccagatgtggaccctgatgtacttccaccggcgcgacctgcggctcgccgcgaacgccatctgctccgccgtgcccagccactgggtccccacctcccgcacgacctggagcatccacgccaagcacgagtggatgaccaccgaggacatgctggccgtgtggaaccgggtgtggatccaggagaacccgtggatggaggacaagacgcccgtcgagtcctgggaggaggtgccctacctgggcaagcgcgaggaccagtggtgcgggagcctcatcggcctgaccagccgcgcgacctgggccaagaacatccagaccgccatcaaccaggtgcggtccctgatcgggaacgaggagtacacggactacatgcccagcatgaagcgcttccggaaggaggaggaggaggccggcgtcctctggtga

SEQ ID NO: 9359 - RNA, 9876 nt, synthetic construct
  misc_feature 1..9876: note = derived and/or modified CDS sequence (opt1) from DENV-2__EU482552__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccaccgggaaggccctgcaccaggtcttcggcgcgatctacggcgccgccttcagcggggtgtcctggacgatgaagatcctgatcggcgtgatcatcacctggatcgggatgaacagccgctccaccagcctgtccgtcagcctcgtgctggtgggcgtcgtgaccctgtacctcggggtgatggtccaggccgacacgggctgcgtggtgtcctggaagaacaaggagctgaagtgcggcagcgggatcttcatcaccgacaacgtccacacctggaccgagcagtacaagttccagcccgagtcccccagcaagctggcgagcgccatccagaaggcccacgaggagggcatctgcgggatccggtccgtgacgcgcctcgagaacctgatgtggaagcagatcacccccgagctgaaccacatcctcagcgagaacgaggtgaagctgaccatcatgaccggcgacatcaaggggatcatgcaggccggcaagcggtccctgcgcccgcagcccacggagctcaagtacagctggaagacctggggcaaggccaagatgctgtccaccgagagccacaaccagaccttcctgatcgacgggcccgagacggcggagtgcccgaacaccaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacgcagaccgccgggccctggcacctgggcaagctggagatggacttcgacttctgcgaggggaccaccgtcgtggtgacggaggactgcggcaaccggggccccagcctccgcaccaccaccgcgagcgggaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggtacggccagatcgacaacttctccctgggcgtgctggggatggccctcttcctggaggagatgctgcggacccgcgtcggcacgaagcacgccatcctcctggtggcggtgagcttcgtcaccctgatcaccgggaacatgtccttccgggacctcggccgcgtgatggtgatggtcggggccaccatgacggacgacatcggcatgggcgtgacctacctggccctgctcgccgccttcaaggtgcgccccaccttcgcggccgggctgctgctccggaagctgaccagcaaggagctgatgatggccacgatcggcatcgccctcctgtcccagagcaccatccccgagaccatcctggagctcaccgacgccctggcgctggggatgatggtcctcaagatcgtgcgcaacatggagaagtaccagctggccgtgacgatcatggccatctcctgcgtcccgaacgccgtgatcctgcagaacgcctggaaggtgagctgcaccatcctcgcggccgtctccgtgagccccctgctgctcacctccagccagcagaaggccgactggatccccctggccctgaccatcaagggcctcaaccccacggcgatcttcctgaccaccctgtcccggaccagcaagaagcgctcctggccgctcaacgaggccatcatggccgtcggcatggtgagcatcctggcctccagcctgctcaagaacgacatccccatgacggggcccctggtggccggcgggctgctcaccgtctgctacgtgctgaccggccggagcgcggacctggagctcgagcgcgccgccgacgtgaagtgggaggaccaggccgagatctccgggagctcccccatcctgagcatcaccatctccgaggacggcagcatgtccatcaagaacgaggaggaggagcacacgctgaccatcctcatccggaccggcctgctggtcatcagcggggtgttcccggtgtccatccccatcaccgccgcggcctggtacctctgggaggtcaagaagcagcgcgccggcgtgctgtgggacgtgcccagcccgccgcccgtcgggaaggccgagctggaggacggcgcctaccggatcaagcagcgcgggatcttcggctactcccagatcggcgcgggggtgtacaaggagggcaccttccacacgatgtggcacgtgacccgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgccctggagcccgggaagaacccccgcgccgtgcagaccaagcccggcctgttcaagaccaacacggggaccatcggcgcggtgagcctcgacttctcccccggcaccagcgggtcccccatcgtcgaccggaagggcaaggtggtggggctgtacggcaacggcgtcgtgacccgcagcggggcctacgtgtccgccatcgcccagacggagaagtccatcgaggacaaccccgagatcgaggacgacatcttccggaagaagcgcctgaccatcatggacctccaccccggcgcggggaagaccaagcggtacctgcccgccatcgtccgcgaggccatcaagcggggcctgcgcaccctgatcctcgccccgacgcgcgtggtggccgcggagatggaggaggccctgcgggggctgcccatccgctaccagacccccgccatccgggccgagcacaccggccgcgagatcgtcgacctcatgtgccacgccaccttcacgatgcggctgctgagccccgtgcgcgtgccgaactacaacctcatcatcatggacgaggcgcacttcaccgaccccgcctccatcgccgcccggggctacatcagcacccgcgtcgagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgcggcctgcctgcgcaagaacggcaagaaggtgatccagctgagccggaagaccttcgactccgagtacgtgaagacgcgcgccaacgactgggacttcgtcgtgaccaccgacatcagcgagatgggggccaacttccgggccgagcgcgtgatcgacccccggcgctgcatgaagcccgtcatcctcaccgacggcgaggagcgggtgatcctggcggggcccatgccggtgacgcactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgtccatgttcgagcccgagcgggagaaggtcgacgcgatcgacggggagtaccgcctgcggggcgaggcccgcaagaccttcgtggacctcatgcggcgcggggacctgcccgtgtggctggcctaccgggtcgccgccgagggcatcaactacgcggaccgccggtggtgcttcgacgggatcaagaacaaccagatcctcgaggagaacgtggaggtggagatctggaccaaggagggcgagcgcaagaagctgaagccgcggtggctggacgcccgcatctacagcgaccccctcgccctgaaggagttcaaggagttcgccgcgggccggaagtccctgacgctcaacctgatcaccgagatggggcgcctgcccaccttcatgacccagaaggcccgggacgccctcgacaacctggccgtcctgcacacggccgaggtgggcgggcgcgcgtacaaccacgccctcagcgagctgcccgagaccctggagaccctcctgctgctcaccctgctggccacggtcaccggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacgtacgtggtcatcgccatcctgaccgtggtggccgccaccatggcgaacgagatggggttcctggagaagaccaagaaggacctcggcctgggcagcatcacgacccaggagagcgagtccaacatcctggacatcgacctccgcccggccagcgcctggaccctgtacgccgtcgccaccacgttcgtgacccccatgctgcggcactccatcgagaacagctccgtgaacgtcagcctcaccgcgatcgccaaccaggccaccgtgctgatggggctgggccgcgggtggcccctctccaagatggacatcggcgtgcccctgctggccatcgggtgctacagccaggtcaacccgatcacgctcaccgcggccctgctgctcctggtggcccactacgccatcatcggccccggcctgcaggccaaggcgacccgcgaggcccagaagcggaccgccgccgggatcatgaagaaccccacggtggacggcatcaccgtcatcgacctcgagcccatcccgtacgaccccaagttcgagaagcagctgggccaggtgatgctgctcgtgctgtgcgtcacccaggtgctgatgatgcgcaccacgtgggccctctgcgaggcgctgaccctggccaccggccccatctccaccctctgggaggggaaccccggccggttctggaacacgaccatcgccgtgagcatggccaacatcttccgcggctcctacctggccggggcgggcctcctcttcagcatcatgaagaacaccaccaacacgcggcgcgggaccggcaacatcggcgagaccctgggggagaagtggaagtcccggctgaacgccctcggcaagagcgagttccagatctacaagaagtccgggatccaggaggtcgaccgcaccctggccaaggagggcatcaagcgcggggagacggaccaccacgccgtgagccgcggctccgcgaagctgcggtggttcgtggagcgcaacatggtcaccccggagggcaaggtggtggacctcgggtgcggccgcggcgggtggagctactactgcggcgggctgaagaacgtccgcgaggtgaaggggctgaccaagggcgggcccgggcacgaggagcccatccccatgtccacctacggctggaacctcgtgcggctgcagagcggggtcgacgtgttcttcacgccgcccgagaagtgcgacaccctgctctgcgacatcggcgagagctcccccaaccccaccatcgaggccggccgcaccctgcgggtgctgaacctcgtcgagaactggctgaacaacaacacccagttctgcgtgaaggtgctgaacccgtacatgcccagcgtcatcgagaagatggagacgctccagcgcaagtacgggggcgccctggtgcggaaccccctgtcccgcaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagacgaagcagaccggcagcgcctccagcatggtcaacggggtggtgaagctgctcaccaagccctgggacgtcgtgccgatggtgacccagatggccatgacggacaccacccccttcggccagcagcgcgtcttcaaggagaaggtggacacccggacgcaggagcccaaggagggcaccaagaagctgatgcgcatcaccgccgagtggctgtggaaggagctcgggaagaagaagacgccccggatgtgcacgcgcgaggagttcacccggaaggtgcgctccaacgccgcgctgggcgccatcttcaccgacgagaacaagtggaagtccgcccgggaggccgtcgaggactcccgcttctgggagctggtggaccgggagcgcaacctccacctggaggggaagtgcgagacctgcgtctacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtgtccaagaaggagggcggggccatgtacgcggacgacacggccgggtgggacacccgcatcaccctggaggacctcaagaacgaggagatggtcaccaaccacatgaagggcgagcacaagaagctggccgaggccatcttcaagctgacgtaccagaacaaggtggtgcgggtccagcgcccgacgccccgggggaccgtgatggacatcatcagccggaaggaccagcgcggctccggccaggtggggacctacggcctcaacacgttcaccaacatggaggcccagctgatccggcagatggagggggagggcatcttcaagagcatccagcgcctgaccgtcaccgaggagatcgcggtgcagaactggctcgcccgggtgggccgcgagcggctgtcccgcatggccatcagcggggacgactgcgtcgtgaagcccctggacgaccggttcgcctccgccctcacggcgctgaacgacatgggcaaggtgcgcaaggacatccagcagtgggagcccagccgggggtggaacgactggacccaggtcccgttctgctcccaccacttccacgagctggtgatgaaggacggccgcgtgctcgtcgtgccctgccggaaccaggacgagctgatcgggcgcgcccggatcagccagggcgccggctggtccctgaaggagaccgcctgcctcggcaagagctacgcccagatgtggaccctgatgtacttccaccgccgggacctgcgcctcgcggccaacgccatctgctccgccgtgcccagccactgggtccccacctcccggacgacctggagcatccacgccaagcacgagtggatgaccaccgaggacatgctggcggtgtggaaccgcgtgtggatccaggagaacccgtggatggaggacaagacgcccgtcgagtcctgggaggaggtgccctacctgggcaagcgcgaggaccagtggtgcgggagcctcatcggcctgaccagccgggccacctgggccaagaacatccagaccgccatcaaccaggtgcgctccctgatcgggaacgaggagtacacggactacatgcccagcatgaagcggttccgcaaggaggaggaggaggcgggcgtcctctggtga

SEQ ID NO: 9360 - RNA, 9876 nt, synthetic construct
  misc_feature 1..9876: note = derived and/or modified CDS sequence (opt1) from DENV-2__EU482554__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaccgtcgtgctgcccgagaacctggagtacacgatcgtgatcacgccccacagcggggaggagcacgccgtcggcaacgacaccgggaagcacggcaaggagatcaagatcaccccgcagtccagcatcaccgaggccgagctcacggggtacggcaccgtgaccatggagtgcagcccccggaccggcctggacttcaacgagatggtgctgctccagatggaggacaaggcctggctggtccaccggcagtggttcctggacctccccctgccctggctgccgggggccgacacgcagggcagcaactggatccagaaggagaccctcgtgaccttcaagaacccccacgcgaagaagcaggacgtggtcgtgctggggtcccaggagggcgccatgcacaccgccctgacgggggccaccgagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcatggacctcgagaagcggtacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagacgaccatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggacgatgaagatcctgatcggcgtgatcatcacctggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcacggacaacgtccacacctggaccgagcagtacaagttccagcccgagagccccagcaagctggcgtccgccatccagaaggcccacgaggagggcatctgcgggatccggagcgtgacccgcctcgagaacctgatgtggaagcagatcacgcccgagctgaaccacatcctctccgagaacgaggtgaagctgaccatcatgaccggcgacatcaaggggatcatgcaggccggcaagcggagcctgcgcccgcagcccaccgagctcaagtactcctggaagacgtggggcaaggccaagatgctgagcaccgagtcccacaaccagaccttcctgatcgacgggcccgagaccgcggagtgcccgaacacgaaccgggcctggaacagcctcgaggtcgaggactacggcttcggggtgttctccaccaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagacggccgggccctggcacctgggcaagctggagatggacttcgacttctgcgaggggaccaccgtggtggtcaccgaggactgcggcaaccggggccccagcctccgcacgaccaccgcgtccgggaagctgatcaccgagtggtgctgccggagctgcacgctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacccgcgtgggcaccaagcacgccatcctcctggtggcggtctccttcgtgacgctgatcaccgggaacatgagcttccgggacctcggccgcgtgatggtcatggtgggggccaccatgaccgacgacatcggcatgggcgtgacgtacctggccctgctcgccgccttcaaggtccgccccaccttcgcggccgggctgctgctccggaagctgacctccaaggagctgatgatggccaccatcggcatcgccctcctgagccagtccacgatccccgagaccatcctggagctcaccgacgccctggcgctggggatgatggtgctcaagatcgtgcgcaacatggagaagtaccagctggccgtcaccatcatggccatcctgtgcgtgccgaacgccgtgatcctccagaacgcctggaaggtcagctgcacgatcctggcggccgtgtccgtcagccccctgctcctgacctccagccagcagaaggccgactggatccccctggccctcaccatcaagggcctgaaccccaccgcgatcttcctgacgaccctctcccggaccagcaagaagcgctcctggccgctgaacgaggccgtgatggccgtgggcatggtcagcatcctggcctccagcctcctgaagaacgacatccccatgaccgggcccctggtggccggcgggctcctgacggtgtgctacgtcctgaccggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagaccctcacgatcctgatccggaccggcctgctcgtgatcagcggggtcttcccggtgtccatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctactcccagatcggcgcgggggtctacaaggagggcaccttccacaccatgtggcacgtgacgcgcggggccgtgctgatgcaccgcggcaagcggatcgagcccagctgggccgacgtcaagaaggacctgatctcctacgggggcggctggaagctcgagggggagtggaaggagggcgaggaggtccaggtgctggccctggagcccgggaagaacccccgcgccgtccagaccaagcccggcctcttcaagaccaacaccgggacgatcggcgcggtgagcctggacttctcccccggcaccagcgggtcccccatcgtggaccggaagggcaaggtcgtggggctgtacggcaacggcgtggtcacccgcagcggggcctacgtgtccgccatcgcccagaccgagaagtccatcgaggacaaccccgagatcgaggacgacatcttccggaagaagcgcctcacgatcatggacctgcaccccggcgcggggaagaccaagcggtacctgcccgccatcgtgcgcgaggccatcaagcggggcctgcgcaccctcatcctggccccgacccgcgtcgtggccgcggagatggaggaggccctgcgggggctccccatccgctaccagacgcccgccatccgggccgagcacaccggccgcgagatcgtggacctgatgtgccacgccaccttcaccatgcggctgctcagccccgtccgcgtgccgaactacaacctgatcatcatggacgaggcgcacttcacggaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtcacggacttcaaggggaagaccgtgtggttcgtgccgtccatcaaggccggcaacgacatcgcggcctgcctgcgcaagaacggcaagaaggtcatccagctcagccggaagaccttcgactccgagtacgtgaagacccgcgccaacgactgggacttcgtggtcacgaccgacatcagcgagatgggggccaacttccgggccgagcgcgtgatcgacccccggcgctgcatgaagcccgtgatcctgaccgacggcgaggagcgggtcatcctggcggggcccatgccggtgacccactccagcgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacgcccgagggcatcatcccgtccatgttcgagcccgagcgggagaaggtggacgcgatcgacggggagtaccgcctccggggcgaggcccgcaagaccttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggaccaaggagggcgagcgcaagaagctgaagccgcggtggctcgacgcccgcatctacagcgaccccctggccctgaaggagttcaaggagttcgccgcgggccggaagtccctcaccctgaacctgatcacggagatggggcgcctccccaccttcatgacccagaaggcccgggacgccctggacaacctggccgtcctccacaccgccgaggtgggcgggcgcgcgtacaaccacgccctgagcgagctgcccgagacgctcgagaccctgctgctcctgaccctgctcgccaccgtgacgggcggcatcttcctgttcctgatgtccgggaagggcatcgggaagatgaccctcggcatgtgctgcatcatcaccgccagcatcctgctgtggtacgcccagatccagccgcactggatcgcggcctccatcatcctcgagttcttcctgatcgtcctgctcatccccgagcccgagaagcagcggacgccccaggacaaccagctgacctacgtggtgatcgccatcctgacggtcgtggccgccaccatggcgaacgagatggggttcctcgagaagaccaagaaggacctgggcctgggcagcatcatcacccaggagagcgagtccaacatcctcgacatcgacctgcgcccggccagcgcctggacgctgtacgccgtggccaccaccttcgtcacccccatgctccggcactccatcgagaacagctccgtgaacgtgagcctgacggcgatcgccaaccaggccaccgtcctgatggggctcggccgcgggtggcccctgtccaagatggacatcggcgtgcccctgctcgccatcgggtgctacagccaggtgaacccgatcaccctgaccgcggccctgctcctgctggtcgcccactacgccatcatcggccccggcctccaggccaaggcgacgcgcgaggcccagaagcgggccgccgccgggatcatgaagaaccccaccgtggacggcatcaccgtgatcgacctggagcccatcccgtacgaccccaagttcgagaagcagctggggcaggtcatgctcctggtgctgtgcgtgacccaggtcctcatgatgcgcacgacctgggcgctgtgcgaggccctgaccctcgccaccggccccatctccacgctgtgggaggggaaccccggccggttctggaacaccaccatcgccgtgagcatggccaacatcttccgcggctcctacctggcgggggccggcctcctgttcagcatcatgaagaacaccacgaacacccggcgcgggaccggcaacatcggcgagaccctgggggagaagtggaagtcccggctcaacgccctgggcaagagcgagttccagatctacaagaagtccgggatccaggaggtggaccgcacgctggccaaggagggcatcaagcgcggggagaccgaccaccacgcggtcagccgcggctccgccaagctccggtggttcgtggagcgcaacatggtgaccccggagggcaaggtcgtggacctggggtgcggccgcggcgggtggagctactactgcggcgggctgaagaacgtgcgcgaggtcaaggggctcaccaagggcgggcccgggcacgaggagcccatccccatgtccacgtacggctggaacctggtgcggctgcagagcggggtggacgtcttcttcaccccgcccgagaagtgcgacaccctcctgtgcgacatcggcgagagctcccccaaccccaccatcgaggccggccgcacgctgcgggtgctcaacctggtggagaactggctgaacaacaacacccagttctgcatcaaggtcctcaacccgtacatgcccagcgtgatcgagaagatggagaccctgcagcgcaagtacgggggcgccctggtgcggaaccccctgtcccgcaacagcacccacgagatgtactgggtctccaacgccaccgggaacatcgtgagctccgtgaacatgatcagccgcatgctcatcaaccggttcacgatgaagcacaagaaggcgacctacgagccggacgtcgacctgggctccgggacccgcaacatcggcatcgagaacgagatccccaacctggacatcatcggcaagcggatcgagaagatcaagcaggagcacgagaccagctggcactacgaccaggaccacccctacaagacgtgggcctaccacgggtcctacgagaccaagcagaccggcagcgcctccagcatggtgaacggggtggtccgcctcctgaccaagccctgggacgtggtgccgatggtcacgcagatggccatgaccgacaccacccccttcggccagcagcgggtgttcaaggagaaggtggacacgcgcacccaggagcccaaggagggcaccaagaagctgatgcggatcaccgccgagtggctctggaaggagctggggaagaagaagacgccccgcatgtgcacccgggaggagttcacccgcaaggtccggtccaacgcggccctgggcgccatcttcaccgacgagaacaagtggaagtccgcccgcgaggccgtggaggactcccggttctgggagctcgtcgaccgcgagcggaacctgcacctggaggggaagtgcgagacgtgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttctcccgggggaacagcctgagcggcgtggagggggagggcctccacaagctgggctacatcctgcgcgacgtctccaagaaggagggcggcgcgatgtacgccgacgacaccgccgggtgggacacccggatcaccctcgaggacctgaagaacgaggagatggtgacgaaccacatgaagggcgagcacaagaagctggccgaggccatcttcaagctcacctaccagaacaaggtggtccgcgtgcagcgcccgacgccccgggggaccgtgatggacatcatcagccgcaaggaccagcggggctccggccaggtcgggacgtacggcctgaacaccttcaccaacatggaggcgcagctgatccgccagatggagggggagggcatcttcaagagcatccagcacctcaccgtgacggaggagatcgccgtgcagaactggctggcccgggtcggccgcgagcggctgtcccgcatggccatcagcggggacgactgcgtggtgaagcccctcgacgaccggttcgcctccgcgctgaccgccctgaacgacatgggcaaggtccgcaaggacatccagcagtgggagcccagccgggggtggaacgactggacccaggtgccgttctgctcccaccacttccacgagctcgtgatgaaggacggccgcgtcctggtggtgccctgccggagccaggacgagctgatcgggcgcgcccggatctcccagggcgccggctggagcctcaaggagaccgcctgcctggggaagtcctacgcgcagatgtggacgctgatgtacttccaccgccgggacctccgcctggccgccaacgccatctgcagcgccgtcccctcccactgggtgcccaccagccggaccacctggtccatccacgcgaagcacgagtggatgaccacggaggacatgctggccgtgtggaaccgcgtctggatccaggagaacccgtggatggaggacaagaccctcgtggagagctgggaggaggtgccctacctgggcaagcgcgaggaccagtggtgcgggagcctgatcggcctcacctcccgggccacctgggccaagaacatccagacggcgatcaaccaggtccgcagcctgatcgggaacgaggagtacaccgactacatgccctccatgaagcggttccgcaaggaggaggaggaggccggcgtgctgtggtga

SEQ ID NO: 9361 - RNA, 9876 nt, synthetic construct
  misc_feature 1..9876: note = derived and/or modified CDS sequence (opt1) from DENV-2__EU482556__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggtgagccacgagatggtcctgctccagatggaggacaaggcctggctggtgcaccggcagtggttcctggacctccccctgccctggctgccgggggccgacacccagggctccaactggatccagaaggagacgctcgtgaccttcaagaacccccacgcgaagaagcaggacgtcgtggtcctggggagccaggagggcgccatgcacaccgccctgaccggggccacggagatccagatgagctccggcaacctcctgttcaccggccacctgaagtgccgcctccggatggacaagctgcagctgaaggggatgagctactccatgtgcaccggcaagttcaagatcgtgaaggagatcgccgagacccagcacgggacgatcgtgatccgcgtccagtacgagggcgacggcagcccctgcaagatccccttcgagatcatggacctcgagaagcggcacgtgctggggcgcctgatcaccgtgaacccgatcgtcaccgagaaggactcccccgtgaacatcgaggcggagccgcccttcggcgacagctacatcatcatcggggtggagccgggccagctcaagctgaactggttcaagaaggggtccagcatcggccagatgttcgagaccacgatgcgcggcgccaagcggatggccgtcctgggggacaccgcctgggacttcggctccctcgggggcgtgttcaccagcatcgggaaggccctgcaccaggtgttcggcgcgatctacggcgccgccttctccggggtcagctggaccatgaagatcctgatcggcgtgatcatcacgtggatcgggatgaactcccgcagcacctccctgagcgtgtccctcgtcctggtgggcgtggtcaccctgtacctcggggtgatggtgcaggccgacaccggctgcgtcgtgagctggaagaacaaggagctgaagtgcggctccgggatcttcatcacggacaacgtgcacacctggaccgagcagtacaagttccagcccgagagccccagcaagctggcgtccgccatccagaaggcccacgaggagggcatctgcgggatccggagcgtcacccgcctcgagaacctgatgtggaagcagatcacgcccgagctgaaccacatcctctccgagaacgaggtgaagctgaccatcatgaccggcgacatcaaggggatcatgcaggccggcaagcggagcctgcgcccgcagcccaccgagctcaagtactcctggaagacgtggggcaaggccaagatgctgagcaccgagtcccacaaccagaccttcctgatcgacgggcccgagaccgcggagtgcccgaacacgaaccgggcctggaacagcctcgaggtggaggactacggcttcggggtcttctccaccaacatctggctgaagctgcgcgagaagcaggacgtgttctgcgacagcaagctcatgtccgccgccatcaaggacaaccgggccgtgcacgcggacatgggctactggatcgagagcgccctgaacgacacctggaagatggagaaggcctccttcatcgagatcaagagctgccactggcccaagtcccacaccctgtggagcaacggcgtcctcgagtccgagatgatcatccccaagaacttcgccgggcccgtgagccagcacaactaccgcccgggctaccacacccagacggccgggccctggcacctgggcaagctggagatggacttcgacttctgcgaggggaccaccgtggtcgtgaccgaggactgcggcaaccggggccccagcctccgcacgaccaccgcgtccgggaagctgatcaccgagtggtgctgccggagctgcacgctgcccccgctccgctaccggggcgaggacgggtgctggtacggcatggagatccgccccctgaaggagaaggaggagaacctggtgaactccctcgtcaccgccgggcacggccagatcgacaacttcagcctgggcgtgctggggatggccctcttcctggaggagatgctgcggacccgcgtgggcaccaagcacgccatcctcctggtcgcggtgtccttcgtgacgctgatcaccgggaacatgagcttccgggacctcggccgcgtcatggtgatggtgggggccaccatgaccgacgacatcggcatgggcgtcacgtacctggccctgctcgccgccttcaaggtgcgccccaccttcgcggccgggctgctgctccggaagctgacctccaaggagctgatgatggccaccatcggcatcgccctcctgagccagtccacgatccccgagaccatcctggagctcaccgacgccctggcgctggggatgatggtgctcaagatcgtccgcaacatggagaagtaccagctggccgtgaccatcatggccatcagctgcgtgccgaacgccgtcatcctgcagaacgcctggaaggtgtcctgcacgatcctcgcggccgtcagcgtgagccccctgctgctcaccagctcccagcagaaggccgactggatccccctggccctgaccatcaagggcctcaaccccaccgcgatcttcctgacgaccctgagccggacctccaagaagcgcagctggccgctcaacgaggccgtgatggccgtcggcatggtgtccatcctggccagcagcctgctcaagaacgacatccccatgaccgggcccctggtggccggcgggctgctcacggtctgctacgtgctgaccggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgacgatcctcatccggaccggcctgctggtcatctccggggtgttcccggtgagcatccccatcaccgccgcggcctggtacctctgggaggtcaagaagcagcgcgccggcgtgctgtgggacgtgcccagcccgccgcccgtcgggaaggccgagctggaggacggcgcctaccggatcaagcagcgcgggatcttcggctacagccagatcggcgcgggggtgtacaaggagggcaccttccacaccatgtggcacgtgacgcgcggggccgtcctcatgcaccgcggcaagcggatcgagccctcctgggccgacgtgaagaaggacctgatcagctacgggggcggctggaagctggagggggagtggaaggagggcgaggaggtgcaggtcctcgccctggagcccgggaagaacccccgcgccgtgcagaccaagcccggcctgttcaagaccaacaccgggacgatcggcgcggtgtccctcgacttcagccccggcacctccgggagccccatcgtcgaccggaagggcaaggtggtggggctgtacggcaacggcgtcgtgacccgctccggggcctacgtgagcgccatcgcccagaccgagaagtccatcgaggacaaccccgagatcgaggacgacatcttccggaagaagcgcctgacgatcatggacctccaccccggcgcggggaagaccaagcggtacctgcccgccatcgtccgcgaggccatcaagcggggcctgcgcaccctgatcctcgccccgacccgcgtggtggccgcggagatggaggaggccctgcgggggctgcccatccgctaccagacgcccgccatccgggccgagcacaccggccgcgagatcgtcgacctcatgtgccacgccaccttcaccatgcggctgctgtcccccgtgcgcgtgccgaactacaacctcatcatcatggacgaggcgcacttcacggaccccgccagcatcgccgcccggggctacatctccacccgcgtcgagatgggggaggccgcgggcatcttcatgaccgccacgccgcccgggagccgggacccgttcccccagtccaacgcccccatcatggacgaggagcgcgagatccccgagcggagctggaactccggccacgagtgggtgacggacttcaaggggaagaccgtgtggttcgtcccgagcatcaaggccggcaacgacatcgcggcctgcctgcgcaagaacggcaagaaggtgatccagctgtcccggaagaccttcgacagcgagtacgtgaagacccgcgccaacgactgggacttcgtcgtgacgaccgacatctccgagatgggggccaacttccgggccgagcgcgtgatcgacccccggcgctgcatgaagcccgtcatcctcaccgacggcgaggagcgggtgatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgggagaaggtcgacgcgatcgacggggagtaccgcctgcggggcgaggcccgcaagaccttcgtggacctcatgcggcgcggggacctgcccgtgtggctggcctaccgggtcgccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcacggagatggggcgcctgcccaccctcatgacccagaaggcccgggacgccctggacaacctggccgtgctccacaccgccgaggtgggcgggcgcgcgtacaaccacgccctgtccgagctgcccgagacgctcgagaccctgctgctcctgaccctgctcgccaccgtcacgggcggcatcttcctgttcctgatgagcgggaagggcatcgggaagatgaccctcggcatgtgctgcatcatcaccgcctccatcctgctgtggtacgcccagatccagccgcactggatcgcggccagcatcatcctcgagttcttcctgatcgtgctgctcatccccgagcccgagaagcagcggacgccccaggacaaccagctgacctacgtggtcatcgccatcctgacggtggtggccgccaccatggcgaacgagatggggttcctcgagaagaccaagaaggacctgggcctgggcagcatcaccacgcaggagtccgagagcaacatcctcgacatcgacctgcgcccggcctccgcctggaccctgtacgccgtcgccaccaccttcgtgacgcccatgctccggcacagcatcgagaactccagcgtgaacgtctccctgaccgcgatcgccaaccaggccaccgtgctgatggggctcggccgcgggtggcccctgagcaagatggacatcggcgtgcccctgctcgccatcgggtgctactcccaggtcaacccgatcaccctgacggcggccctgctcctgctggtggcccactacgccatcatcggccccggcctccaggccaaggcgacccgcgaggcccagaagcggaccgccgccgggatcatgaagaaccccaccgtggacggcatcacggtcatcgacctggagcccatcccgtacgaccccaagttcgagaagcagctgggccaggtgatgctcctggtgctgtgcgtcacccaggtgctcatgatgcgcaccacctgggccctgtgcgaggcgctgacgctcgccaccggccccatcagcaccctgtgggaggggaaccccggccggttctggaacaccacgatcgccgtgtccatggccaacatcttccgcggcagctacctggccggggcgggcctcctgttctccatcatgaagaacaccaccaacacccggcgcgggacgggcaacatcggcgagaccctgggggagaagtggaagtcccggctcaacgccctgggcaagtccgagttccagatctacaagaagtccgggatccaggaggtcgaccgcaccctggccaaggagggcatcaagcgcggggagaccgaccaccacgccgtgtcccgcggcagcgcgaagctccggtggttcgtggagcgcaacatggtcacgccggagggcaaggtggtggacctggggtgcggccgcggcgggtggtcctactactgcggcgggctgaagaacgtccgcgaggtgaaggggctcaccaagggcgggcccgggcacgaggagcccatccccatgagcacctacggctggaacctggtgcggctgcagagcggggtcgacgtgttcttcaccccgcccgagaagtgcgacacgctcctgtgcgacatcggcgagtccagccccaaccccaccatcgaggccggccgcaccctgcgggtgctcaacctggtcgagaactggctgaacaacaacacccagttctgcgtgaaggtgctcaacccgtacatgccctccgtcatcgagaagatggagaccctgcagcgcaagtacgggggcgccctggtgcggaaccccctgagccgcaactccacgcacgagatgtactgggtgagcaacgccaccgggaacatcgtctccagcgtgaacatgatctcccgcatgctcatcaaccggttcaccatgaagcacaagaaggccacctacgagccggacgtggacctgggcagcgggacgcgcaacatcggcatcgagaacgagatccccaacctggacatcatcggcaagcggatcgagaagatcaagcaggagcacgagacctcctggcactacgaccaggaccacccctacaagacctgggcgtaccacgggagctacgagaccaagcagacgggctccgccagctccatggtcaacggggtggtgaagctcctgaccaagccctgggacgtcgtgccgatggtgacccagatggccatgaccgacacgacccccttcggccagcagcgcgtcttcaaggagaaggtggacacccggacccaggagcccaaggagggcacgaagaagctgatgcgcatcaccgccgagtggctctggaaggagctggggaagaagaagacgccccggatgtgcacccgcgaggagttcacgcggaaggtccgcagcaacgccgcgctgggcgccatcttcaccgacgagaacaagtggaagtccgcccgggaggccgtggaggacagccgcttctgggagctcgtggaccgggagcgcaacctgcacctggaggggaagtgcgagacctgcgtctacaacatgatgggcaagcgggagaagaagctcggggagttcggcaaggccaagggctcccgcgcgatctggtacatgtggctgggggcccggttcctggagttcgaggccctcggcttcctgaacgaggaccactggttcagccgcgggaacagcctgtccggcgtggagggggagggcctccacaagctgggctacatcctgcgggacgtgagcaagaaggagggcggggccatgtacgcggacgacaccgccgggtgggacacgcgcatcaccctcgaggacctgaagaacgaggagatggtcaccaaccacatgaagggcgagcacaagaagctggccgaggccatcttcaagctcacctaccagaacaaggtggtgcgggtccagcgcccgacgccccgcgggaccgtgatggacatcatctcccggaaggaccagcgcggcagcggccaggtggggacctacggcctgaacaccttcacgaacatggaggcccagctgatccggcagatggagggggagggcatcttcaagtccatccagcgcctcaccgtcaccgaggagatcgcggtgcagaactggctggtgcgggtcggccgcgagcggctgagccgcatggccgtgtccggggacgactgcgtggtcaagcccctcgacgaccggttcgccagcgccctgaccgccctgaacgacatgggcaaggtgcgcaaggacatccagcagtgggagccctcccgggggtggaacgactggacccaggtgccgttctgcagccaccacttccacgagctcgtcatgaaggacggccgcgtgctggtggtcccctgccggaaccaggacgagctgatcgggcgcgcgcggatctcccagggcgccggctggagcctcaaggagaccgcctgcctggggaagtcctacgcccagatgtggaccctgatgtacttccaccgccgggacctccgcctggccgcgaacgccatctgcagcgccgtgccctcccactgggtgcccaccagccggaccacgtggtccatccacgccaagcacgagtggatgaccaccgaggacatgctggccgtctggaaccgcgtgtggatccaggagaacccgtggatggaggacaagacccccgtggagagctgggaggaggtcccctacctcggcaagcgcgaggaccagtggtgcgggagcctgatcggcctgacgtcccgggcgacctgggccaagaacatccagaccgccatcaaccaggtgcgcagcctcatcgggaacgaggagtacaccgactacatgccctccatgaagcggttccgcaaggaggaggaggaggccggcgtgctgtggtga

SEQ ID NO: 9362 - RNA, 9876 nt, synthetic construct
  misc_feature 1..9876: note = derived and/or modified CDS sequence (opt1) from DENV-2__EU529693__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccaccatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcacgaccatggccaagaacaagcccaccctggacttcgagctgatcaagaccgaggccaagcagcccgccacgctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacacgatcgtgatcacgccccacagcggggaggagcacgccgtcggcaacgacaccgggaagcacggcaaggagatcaagatcaccccgcagtccagcatcaccgaggccgagctcacggggtacggcaccgtgaccatggagtgcagcccccggaccggcctggacttcaacgagatggtgctgctccagatggaggacaaggcctggctggtccaccggcagtggttcctggacctccccctgccctggctgccgggggccgacacgcagggcagcaactggatccagaaggagaccctcgtgaccttcaagaacccccacgcgaagaagcaggacgtggtcgtgctggggtcccaggagggcgccatgcacaccgccctgacgggggccaccgagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagacgaccatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggacgatgaagatcctgatcggcgtgatcatcacctggatcgggatgaacagccgctccaccagcctgtccgtcagcctcgtgctggtgggcatcgtcaccctgtacctcggggtgatggtgcaggccgacacgggctgcgtcgtgtcctggaagaacaaggagctgaagtgcggcagcgggatcttcatcaccgacaacgtgcacacctggaccgagcagtacaagttccagcccgagtcccccagcaagctggcgagcgccatccagaaggcccacgaggagggcatctgcgggatccggtccgtcacgcgcctcgagaacctgatgtggaagcagatcacccccgagctgaaccacatcctcagcgagaacgaggtgaagctgaccatcatgaccggcgacatcaaggggatcatgcaggccggcaagcggtccctgcgcccgcagcccacggagctcaagtacagctggaagacctggggcaaggccaagatgctgtccaccgagagccacaaccagaccttcctgatcgacgggcccgagacggcggagtgcccgaacaccaaccgggcctggaactccctcgaggtggaggactacggcttcggggtcttcagcaccaacatctggctgaagctgcgcgagaagcaggacgtgttctgcgactccaagctcatgagcgccgccatcaaggacaaccgggccgtgcacgcggacatgggctactggatcgagtccgccctgaacgacacctggaagatggagaaggccagcttcatcgagatcaagtcctgccactggcccaagagccacaccctgtggtccaacggcgtcctcgagagcgagatgatcatccccaagaacttcgccgggcccgtgtcccagcacaactaccgcccgggctaccacacgcagaccgccgggccctggcacctgggcaagctggagatggacttcgacttctgcgaggggaccaccgtggtcgtgacggaggactgcggcaaccggggccccagcctccgcaccaccaccgcgagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtcaccgccgggcacggccagatcgacaacttctccctgggcgtgctggggatggccctcttcctggaggagatgctgcggacccgcgtgggcacgaagcacgccatcctcctggtcgcggtgagcttcgtgaccctgatcaccgggaacatgtccttccgggacctcggccgcgtcatggtgatggtgggggccaccatgacggacgacatcggcatgggcgtcacctacctggccctgctcgccgccttcaaggtgcgccccaccttcgcggccgggctgctgctccggaagctgaccagcaaggagctgatgatggccacgatcggcatcgccctcctgtcccagagcaccatccccgagaccatcctggagctcaccgacgccctggcgctggggatgatggtgctcaagatcgtccgcaacatggagaagtaccagctggccgtgacgatcatggccatctcctgcgtgccgaacgccgtcatcctgcagaacgcctggaaggtgagctgcaccatcctcgcggccgtgtccgtcagccccctgctgctcacctccagccagcagaaggccgactggatccccctggccctgaccatcaagggcctcaaccccacggcgatcttcctgaccaccctgtcccggaccagcaagaagcgctcctggccgctcaacgaggccgtgatggccgtcggcatggtgagcatcctggcctccagcctgctcaagaacgacatccccatgacggggcccctggtggccggcgggctgctcaccgtctgctacgtgctgaccggccggagcgcggacctggagctcgagcgcgccgccgacgtgaagtgggaggaccaggccgagatctccgggagctcccccatcctgagcatcaccatctccgaggacggcagcatgtccatcaagaacgaggaggaggagcacacgctgaccatcctcatccggaccggcctgctggtcatcagcggggtgttcccggtgtccatccccatcaccgccgcggcctggtacctctgggaggtcaagaagcagcgcgccggcgtgctgtgggacgtgcccagcccgccgcccgtcgggaaggccgagctggaggacggcgcctaccggatcaagcagcgcgggatcttcggctactcccagatcggcgcgggggtgtacaaggagggcaccttccacacgatgtggcacgtgacccgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgccctggagcccgggaagaacccccgcgccgtgcagaccaagcccggcctgttcaagaccaacacggggaccatcggcgcggtgagcctcgacttctcccccggcaccagcgggtcccccatcgtcgaccggaagggcaaggtggtggggctgtacggcaacggcgtcgtgacccgcagcggggcctacgtgtccgccatcgcccagacggagaagtccatcgaggacaaccccgagatcgaggacgacatcttccggaagaagcgcctgaccatcatggacctccaccccggcgcggggaagaccaagcggtacctgcccgccatcgtccgcgaggccatcaagcggggcctgcgcaccctgatcctcgccccgacgcgcgtggtggccgcggagatggaggaggccctgcgggggctgcccatccgctaccagacccccgccatccgggccgagcacaccggccgcgagatcgtcgacctcatgtgccacgccaccttcacgatgcggctgctgagccccgtgcgcgtgccgaactacaacctcatcatcatggacgaggcgcacttcaccgaccccgcctccatcgccgcccggggctacatcagcacccgcgtcgagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgaccgacttcaaggggaagaccgtgtggttcgtcccgtccatcaaggccggcaacgacatcgcggcctgcctgcgcaagaacggcaagaaggtgatccagctgagccggaagaccttcgactccgagtacgtgaagacgcgcgccaacgactgggacttcgtcgtgaccaccgacatcagcgagatgggggccaacttccgggccgagcgcgtgatcgacccccggcgctgcatgaagcccgtcatcctcaccgacggcgaggagcgggtgatcctggcggggcccatgccggtgacgcactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgtccatgttcgagcccgagcgggagaaggtcgacgcgatcgacggggagtaccgcctgcggggcgaggcccgcaagaccttcgtggacctcatgcggcgcggggacctgcccgtgtggctggcctaccgggtcgccgccgagggcatcaactacgcggaccgccggtggtgcttcgacgggatcaagaacaaccagatcctcgaggagaacgtggaggtggagatctggaccaaggagggcgagcgcaagaagctgaagccgcggtggctggacgcccgcatctacagcgaccccctcgccctgaaggagttcaaggagttcgccgcgggccggaagtccctgacgctcaacctgatcaccgagatggggcgcctgcccaccttcatgacccagaaggcccgggacgccctcgacaacctggccgtcctgcacacggccgaggtgggcgggcgcgcgtacaaccacgccctcagcgagctgcccgagaccctggagaccctcctgctgctcaccctgctggccacggtcaccggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacgtacgtggtcatcgccatcctgaccgtggtggccgccaccatggcgaacgagatggggttcctggagaagaccaagaaggacctcggcctgggcagcatcacgacccaggagagcgagtccaacatcctggacatcgacctccgcccggccagcgcctggaccctgtacgccgtcgccaccacgttcgtgacccccatgctgcggcactccatcgagaacagctccgtgaacgtcagcctcaccgcgatcgccaaccaggccaccgtgctgatggggctgggccgcgggtggcccctctccaagatggacatcggcgtgcccctgctggccatcgggtgctacagccaggtcaacccgatcacgctcaccgcggccctgctgctcctggtggcccactacgccatcatcggccccggcctgcaggccaaggcgacccgcgaggcccagaagcggaccgccgccgggatcatgaagaaccccacggtggacggcatcaccgtcatcgacctcgagcccatcccgtacgaccccaagttcgagaagcagctgggccaggtgatgctgctcgtgctgtgcgtcacccaggtgctgatgatgcgcaccacgtgggccctctgcgaggcgctgaccctggccaccggccccatctccaccctctgggaggggaaccccggccggttctggaacacgaccatcgccgtgagcatggccaacatcttccgcggctcctacctggccggggcgggcctcctcttcagcatcatgaagaacaccaccaacacgcggcgcgggaccggcaacatcggcgagaccctgggggagaagtggaagtcccggctgaacgccctcggcaagagcgagttccagatctacaagaagtccgggatccaggaggtcgaccgcaccctggccaaggagggcatcaagcgcggggagacggaccaccacgccgtgagccgcggctccgcgaagctgcggtggttcgtggagcgcaacatggtcaccccggagggcaaggtggtggacctcgggtgcggccgcggcgggtggagctactactgcggcgggctgaagaacgtccgcgaggtgaaggggctgaccaagggcgggcccgggcacgaggagcccatccccatgtccacctacggctggaacctcgtgcggctgcagagcggggtcgacgtgttcttcacgccgcccgagaagtgcgacaccctgctctgcgacatcggcgagagctcccccaaccccaccatcgaggccggccgcaccctgcgggtgctgaacctcgtcgagaactggctgaacaacaacacccagttctgcgtgaaggtgctgaacccgtacatgcccagcgtcatcgagaagatggagacgctccagcgcaagtacgggggcgccctggtgcggaaccccctgtcccgcaacagcacccacgagatgtactgggtgtccaacgccaccgggaacatcgtcagctccgtgaacatgatcagccgcatgctgatcaaccggttcaccatgaagcacaagaaggccacgtacgagccggacgtggacctcggctccgggacccgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagacgaagcagaccggcagcgcctccagcatggtcaacggggtggtgaagctgctcaccaagccctgggacgtcgtgccgatggtgacccagatggccatgacggacaccacccccttcggccagcagcgcgtcttcaaggagaaggtggacacccggacgcaggagcccaaggagggcaccaagaagctgatgcgcatcaccgccgagtggctgtggaaggagctcgggaagaagaagacgccccggatgtgcacgcgcgaggagttcacccggaaggtgcgctccaacgccgcgctgggcgccatcttcaccgacgagaacaagtggaagtccgcccgggaggccgtcgaggactcccgcttctgggagctggtggaccgggagcgcaacctccacctggaggggaagtgcgagacctgcgtctacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtgtccaagaaggagggcggggccatgtacgcggacgacacggccgggtgggacacccgcatcaccctggaggacctcaagaacgaggagatggtcaccaaccacatgaagggcgagcacaagaagctggccgaggccatcttcaagctgacgtaccagaacaaggtggtgcgggtccagcgcccgacgccccgggggaccgtgatggacatcatcagccggaaggaccagcgcggctccggccaggtggggacctacggcctcaacacgttcaccaacatggaggcccagctgatccggcagatggagggggagggcatcttcaagagcatccagcgcctgaccgtcaccgaggagatcgcggtgcagaactggctcgcccgggtgggccgcgagcggctgtcccgcatggccatcagcggggacgactgcgtcgtgaagcccctggacgaccggttcgcctccgccctcacggcgctgaacgacatgggcaaggtgcgcaaggacatccagcagtgggagcccagccgggggtggaacgactggacccaggtcccgttctgctcccaccacttccacgagctggtgatgaaggacggccgcatgctcgtggtcccctgccggaaccaggacgagctgatcgggcgcgcccggatcagccagggcgccggctggtccctgaaggagaccgcctgcctcggcaagagctacgcccagatgtggaccctgatgtacttccaccgccgggacctgcgcctcgcggccaacgccatctgctccgccgtgcccagccactgggtgcccacctcccggacgacctggagcatccacgccaagcacgagtggatgaccaccgaggacatgctggcggtctggaaccgcgtgtggatccaggagaacccgtggatggaggacaagacgcccgtggagtcctgggaggaggtcccctacctgggcaagcgcgaggaccagtggtgcgggagcctcatcggcctgaccagccgggccacctgggccaagaacatccagaccgccatcaaccaggtgcgctccctgatcgggaacgaggagtacacggactacatgcccagcatgaagcggttccgcaaggaggaggaggaggcgggcgtgctctggtga

SEQ ID NO: 9363 - RNA, 9876 nt, synthetic construct
  misc_feature 1..9876: note = derived and/or modified CDS sequence (opt1) from DENV-2__EU482557__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcggaccgccgccgggatcatgaagaaccccaccgtggacggcatcaccgtgatcgacctcgagcccatcccgtacgaccccaagttcgagaagcagctggggcaggtcatgctgctcgtgctgtgcgtgacgcaggtcctgatgatgcgcaccacctgggccctctgcgaggcgctgaccctggccacgggccccatcagcaccctctgggaggggaaccccggccggttctggaacaccaccatcgccgtgtccatggccaacatcttccgcggcagctacctggccggggcgggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtctcccgcggcagcgcgaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgacgaagggcgggcccgggcacgaggagcccatccccatgagcacctacggctggaacctcgtgcggctgcagagcggggtggacgtcttcttcaccccgcccgagaagtgcgacaccctgctctgcgacatcggcgagtccagccccaaccccacgatcgaggccggccgcaccctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccacggggaacatcgtgtccagcgtgaacatgatctcccgcatgctgatcaaccggttcaccatgaagcacaagaaggccacctacgagccggacgtcgacctcggcagcgggacccgcaacatcggcatcgagaacgagatccccaacctggacatcatcggcaagcggatcgagaagatcaagcaggagcacgagacgtcctggcactacgaccaggaccacccctacaagacctgggcgtaccacgggagctacgagaccaagcagaccggctccgccagctccatggtgaacggggtggtcaagctgctcacgaagccctgggacgtggtgccgatggtcacccagatggccatgaccgacaccacgcccttcggccagcagcgcgtgttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtccgcagcaacgccgcgctgggcgccatcttcacggacgagaacaagtggaagtccgcccgggaggccgtggaggacagccgcttctgggagctggtcgaccgggagcgcaacctccacctggaggggaagtgcgagacctgcgtgtacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtcagcaagaaggagggcggcgccatgtacgcggacgacaccgccgggtgggacacccgcatcacgctggaggacctcaagaacgaggagatggtgaccaaccacatgaagggcgagcacaagaagctggccgaggccatcttcaagctgacctaccagaacaaggtggtccgggtgcagcgcccgacgccccgggggacggtgatggacatcatctcccggaaggaccagcgcggcagcggccaggtcgggacctacggcctcaacaccttcaccaacatggaggcccagctgatccggcagatggagggggagggcatcttcaagtccatccagcgcctgacggtgaccgaggagatcgcggtgcagaactggctcgcccgggtcggccgcgagcggctgagccgcatggccatctccggggacgactgcgtggtgaagcccctggacgaccggttcgccagcgccctcaccgcgctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgccggctggagcctgaaggagacggcctgcctcgggaagtcctacgcccagatgtggaccctgatgtacttccaccgccgggacctgcgcctcgcggccaacgccatctgcagcgccgtcccctcccactgggtgcccaccagccggaccacctggtccatccacgccaagcacgagtggatgacgaccgaggacatgctggcggtgtggaaccgcgtctggatccaggagaacccgtggatggaggacaagacccccgtggagagctgggaggaggtgccctacctgggcaagcgcgaggaccagtggtgcgggagcctcatcggcctgacctcccgggccacgtgggccaagaacatccagaccgccatcaaccaggtccgcagcctgatcgggaacgaggagtacaccgactacatgccctccatgaagcggttccgcaaggaggaggaggaggcgggcgtgctctggtga

SEQ ID NO: 9364 - RNA, 9876 nt, synthetic construct
  misc_feature 1..9876: note = derived and/or modified CDS sequence (opt1) from DENV-2__EU482560__SS-prME
  source 1..9876: mol_type = other RNA
accgccggcgtcatcgtcatgctgatccccaccgtgatggccttccacctcaccacccgcaacggggagccccacatgatcgtgggccggcaggagaaggggaagtccctgctgttcaagaccgaggacggcatcaacatgtgcaccctcatggcgatcgacctgggggagctgtgcgaggacaccatcacctacaagtgccccctcctgaagcagaacgagcccgaggacatcgactgctggtgcaacagcaccagcacctgggtcacctacgggacctgcaccaccacgggcgagcaccgccgggagaagcgctccgtggccctggtgccccacgtcgggatgggcctcgagacccggaccgagacctggatgagctccgagggggcctggaagcacgtgcagcgcatcgagacgtggatcctgcggcacccgggcttcaccatcatggccgccatcctggcgtacaccatcgggaccacgcacttccagcgcgccctcatcttcatcctgctgaccgccgtggcccccagcatgaccatgcggtgcatcggcatctccaaccgcgacttcgtcgagggcgtgagcgggggctcctgggtggacatcgtcctcgagcacgggagctgcgtgaccacgatggcgaagaacaagcccaccctggacttcgagctgatcaagaccgaggccaagcagcccgccaccctccggaagtactgcatcgaggccaagctgacgaacaccaccaccgagtcccgctgcccgacgcagggcgagcccagcctgaacgaggagcaggacaagcggttcatctgcaagcactccatggtggaccgcggctgggggaacggctgcgggctgttcggcaagggcgggatcgtgacctgcgccatgttcacgtgcaagaagaacatggagggcaaggtggtgcagcccgagaacctggagtacaccatcgtcatcacgccccacagcggggaggagcacgcggtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccgccagtggttcctggacctgcccctcccctggctgccgggggccgacacccagggcagcaactggatccagaaggagacgctggtgaccttcaagaacccccacgccaagaagcaggacgtcgtggtcctcgggtcccaggagggcgcgatgcacaccgccctgaccggggccacggagatccagatgagcagcggcaacctcctgttcaccggccacctgaagtgccggctgcgcatggacaagctccagctgaaggggatgtcctacagcatgtgcaccggcaagttcaagatcgtgaaggagatcgccgagacccagcacgggacgatcgtgatccgggtccagtacgagggcgacggctccccctgcaagatccccttcgagatcaccgacctggagaagcgccacgtgctcgggcggctgatcaccgtgaacccgatcgtcaccgagaaggacagccccgtgaacatcgaggccgagccgcccttcggcgactcctacatcatcatcggggtggagccgggccagctgaagctcaactggttcaagaaggggagctccatcggccagatgttcgagacgaccatgcgcggcgcgaagcgcatggccatcctgggggacaccgcctgggacttcggcagcctcgggggcgtcttcacctccatcgggaaggccctccaccaggtgttcggcgccatctacggcgcggccttcagcggggtgtcctggacgatgaagatcctgatcggcgtcatcatcacctggatcgggatgaacagccggtccaccagcctgtccgtgagcctggtgctcgtcggcgtggtgaccctgtacctgggggccatggtccaggccgactccggctgcgtggtgagctggaagaacaaggagctcaagtgcggctccgggatcttcatcacggacaacgtccacacctggaccgagcagtacaagttccagcccgagagccccagcaagctggcgtccgccatccagaaggcccacgaggagggcatctgcgggatccgcagcgtgacccggctggagaacctcatgtggaagcagatcacgcccgagctgaaccacatcctgtccgagaacgaggtgaagctcaccatcatgaccggcgacatcaaggggatcatgcaggccggcaagcgcagcctgcggccgcagcccaccgagctgaagtactcctggaagacgtggggcaaggccaagatgctcagcaccgagtcccacaaccagaccttcctgatcgacgggcccgagaccgcggagtgcccgaacacgaaccgcgcctggaacagcctggaggtcgaggactacggcttcggggtgttcaccaccaacatctggctcaagctgcgggagaagcaggacgccttctgcgactccaagctgatgagcgccgccatcaaggacaaccgcgcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaaccaccggccgggctaccacacgcagaccgcggggccctggcacctcggcaagctggagatggacttcgacttctgcgaggggaccaccgtcgtggtgacggaggactgcggcaaccgcggccccagcctgcggaccaccaccgccagcgggaagctcatcacggagtggtgctgccgctcctgcaccctgcccccgctgcggtaccgcggcgaggacgggtgctggtacggcatggagatccggcccctcaaggagaaggaggagaacctggtcaacagcctggtgaccgccgggcacggccagatcgacaacttctccctcggcgtgctggggatggccctgttcctcgaggagatgctgcgcacccgggtcggcacgaagcacgcgatcctgctcgtggccgtgagcctggtcaccctgatcaccgggaacatgtccttccgcgacctcggccgggtgatggtgatggtcggggccaccatgacggacgacatcggcatgggcgtgacctacctggccctgctcgccgcgttcaaggtgcgccccaccttcgccgccgggctgctgctccgcaagctgaccagcaaggagctgatgatggccacgatcggcatcgccctcctgtcccagagcaccatccccgagaccatcctggagctcaccgacgcgctggccctggggatgatggtcctcaagatcgtgcggaacatggagaagtaccagctggccgtgacgatcatggccatctcctgcgtcccgaacgccgtgatcctgcagaacgcgtggaaggtgagctgcaccatcctcgccgccgtctccgtgagccccctgctgctcacctccagccagcagaaggccgactggatccccctggcgctgaccatcaagggcctcaaccccacggccatcttcctgaccaccctgtcccgcaccagcaagaagcggtcctggccgctcaacgaggccatcatggccgtcggcatggtgagcatcctggcctccagcctgctcaagaacgacatccccatgacggggcccctggtggcgggcgggctgctcaccgtctgctacgtgctgaccggccgcagcgccgacctggagctcgagcgggccgccgacgtgaagtgggaggaccaggccgagatctccgggagctcccccatcctgagcatcaccatctccgaggacggcagcatgtccatcaagaacgaggaggaggagcagacgctgaccatcctcatccgcaccggcctgctggtcatcagcggggtgttcccggtgtccatccccatcaccgcggccgcctggtacctctgggaggtcaagaagcagcgggccggcgtgctgtgggacgtgcccagcccgccgcccgtcgagaaggccgagctggaggacggggcgtaccgcatcaagcagcggggcttcctcgggtactcccagatcggcgccggcgtgtacaaggaggggaccttccacacgatgtggcacgtgacccgcggcgccgtcctgatgcaccgggggaagcgcatcgagcccagctgggccgacgtgaagaaggacctgatctcctacggcgggggctggaagctcgagggcgagtggaaggagggggaggaggtgcaggtcctggccctggagcccggcaagaacccccgggcggtgcagaccaagcccgggatcttcaagaccaacacgggcaccatcggggccgtgagcctcgacttctcccccggcaccagcggctcccccatcgtcgaccgcaaggggaaggtggtgggcctgtacgggaacggcgtcgtgacccggagcggcgcctacgtgtccgccatcgcgcagacggagaagtccatcgagaacaaccccgagatcgaggacgacatcttccgcaagaagcggctgaccatcatggacctccaccccggggccggcaagaccaagcgctacctgcccgccatcgtccgggaggccatcaagcgcgggctgcggaccctgatcctcgccccgacgcgcgtggtggcggccgagatggaggaggccctgcgcggcctgcccatccggtaccagacccccgccatccgcgccgagcacaccgggcgggagatcgtcgacctcatgtgccacgcgaccttcacgatgcgcctgctgagccccgtgcgggtgccgaactacaacctcatcatcatggacgaggcccacttcaccgaccccgcctccatcgccgcccgcggctacatcagcacccgggtcgagatgggcgaggcggccgggatcttcatgaccgccacgccgcccggctcccgcgacccgttcccccagagcaacgcccccatcatggacgaggagcgggagatccccgagcgctcctggaacagcgggcacgagtgggtgaccgacttcaagggcaagaccgtgtggttcgtcccgtccatcaaggcggggaacgacatcgccgcctgcctgcggaagaacggcaagaaggtgatccagctgagccgcaagaccttcgactccgagtacgtgaagacgcgggccaacgactgggacttcgtcgtgaccaccgacatcagcgagatgggcgccaacttcaaggcggagcgcgtgatcgacccccggcgctgcatgaagcccgtcatcctcaccgacggggaggagcgggtgatcctggccggccccatgccggtgacgcactccagcgccgcccagcgccgggggcgcatcggccgcaaccccaagaacgagaacgaccagtacatctacatgggggagcccctggagaacgacgaggactgcgcccactggaaggaggcgaagatgctcctggacaacatcaacacccccgagggcatcatcccgtccatgttcgagcccgagcgggagaaggtcgacgccatcgacggcgagtaccgcctgcgcggggaggcccgcaagaccttcgtggacctcatgcggcgcggcgacctgcccgtgtggctggcctacaaggtcgccgcggaggggatcaactacgccgaccggaagtggtgcttcgacggcatcaagaacaaccagatcctcgaggagaacgtggaggtggagatctggaccaaggagggggagcgcaagaagctgaagccgcggtggctggacgcccgcatctacagcgaccccctcgccctgaaggagttcaaggagttcgcggccggccggaagtccctgacgctcaacctgatcaccgagatgggccgcctgcccaccttcatgacccagaaggcccggaacgccctcgacaacctggccgtcctgcacacggcggaggccgggggccgcgcctacaaccacgccctcagcgagctgcccgagaccctggagaccctcctgctgctcaccctgctggccacggtgaccgggggcatcttcctcttcctgatgtccggcaaggggatcggcaagatgaccctggggatgtgctgcatcatcaccgcgagcatcctcctgtggtacgcccagatccagccgcactggatcgccgcctccatcatcctggagttcttcctcatcgtcctgctgatccccgagcccgagaagcagcggacgccccaggacaaccagctcacgtacgtggtgatcgccatcctgaccgtcgtggcggccaccatggccaacgagatgggcttcctggagaagaccaagaaggacctcgggctgggcagcatcacgacccaggagagcgagtccaacatcctggacatcgacctccgcccggccagcgcctggaccctgtacgcggtggccaccacgttcgtcacccccatgctgcggcactccatcgagaacagctccgtgaacgtgagcctcaccgccatcgccaaccaggcgaccgtcctgatgggcctggggaagggctggcccctctccaagatggacatcggggtgcccctgctggccatcggctgctacagccaggtgaacccgatcacgctcaccgccgccctgctgctcctggtcgcccactacgcgatcatcgggcccggcctgcaggccaaggccacccgcgaggcccagaagcgggccgcggccggcatcatgaagaaccccaccgtggacgggatcacggtgatcgacctcgagcccatcccgtacgaccccaagttcgagaagcagctgggccaggtcatgctgctcatcctgtgcgtgacccaggtgctgatgatgcgcaccacctgggccctctgcgaggccctgacgctggccaccgggcccatctccaccctctgggagggcaaccccgggcggttctggaacaccacgatcgcggtcagcatggccaacatcttccgcggctcctacctggccggcgccgggctcctgttcagcatcatgaagaacaccaccaacacccgccggggcacggggaacatcggcgagaccctgggcgagaagtggaagtcccgcctgaacgcgctcggcaagagcgagttccagatctacaagaagtccggcatccaggaggtggaccggaccctggccaaggaggggatcaagcgcggcgagaccgaccaccacgccgtgagccgggggtccgccaagctgcgctggttcgtcgagcggaacatggtgacgccggagggcaaggtggtcgacctcggctgcgggcgcggcgggtggagctactactgcggcgggctgaagaacgtgcgggaggtgaagggcctgaccaagggcgggcccggccacgaggagcccatccccatgtccacctacgggtggaacctcgtccgcctgcagagcggcgtggacgtgttcttcaccccgcccgagaagtgcgacacgctgctctgcgacatcggggagagctcccccaaccccaccatcgaggccggccggaccctgcgcgtcctgaacctcgtggagaactggctgaacaacaacacccagttctgcatcaaggtgctgaacccgtacatgcccagcgtcatcgagaagatggagaccctccagcggaagtacggcggggcgctggtgcgcaaccccctgtcccggaacagcacgcacgagatgtactgggtgtccaacgccaccggcaacatcgtcagctccgtgaacatgatcagccgcatgctgatcaaccggttcaccatgaagcacaagaaggccacctacgagccggacgtggacctcgggtccggcacgcgcaacatcgggatcgagagcgagatccccaacctggacatcatcggcaagcggatcgagaagatcaagcaggagcacgagacctcctggcactacgaccaggaccacccctacaagacctgggcctaccacggcagctacgagaccaagcagacggggtccgccagctccatggtcaacggcgtggtgcgcctgctcaccaagccctgggacgtcgtgccgatggtgacccagatggcgatgaccgacacgacccccttcgggcagcagcgcgtcttcaaggagaaggtggacacccggacccaggagcccaaggagggcacgaagaagctgatgaagatcaccgccgagtggctgtggaaggagctcggcaagaagaagacgccccgggtgtgcacccgggaggagttcacgcgcaaggtccggagcaacgccgccctgggggccatcttcaccgacgagaacaagtggaagtccgcgcgcgaggccgtggaggacggccggttctgggagctggtggaccgcgagcggaacctccacctggaggggaagtgcgagacctgcgtctacaacatgatgggcaagcgcgagaagaagctgggggagttcggcaaggccaagggcagccgggccatctggtacatgtggctcggggcgcgcttcctggagttcgaggccctgggcttcctcaacgaggaccactggttctcccgggggaacagcctgagcggcgtggagggggagggcctgcaccgcctcggctacatcctgcgggacgtcgggaagaaggagggcggggccatgtacgccgacgacaccgccggctgggacacgcgcatcaccctggaggacctcaagaacgaggagatggtgaccaaccacatgaagggggagcacaagaagctggcggaggccatcttcaagctgacctaccagaacaaggtggtccgggtgcagcgcccgacgccccggggcaccgtgatggacatcatctcccgccgggaccagcgcggcagcgggcaggtcggcacctacgggctcaacaccttcacgaacatggaggcccagctgatccgccagatggagggcgagggcatcttcaagtccatccagcacctgaccgccaccgaggagatcgccgtgcagaactggctcgcgcgggtggggcgcgagcggctgagccgcatggccatctccggcgacgactgcgtcgtgaagcccatcgacgaccggttcgccagcgccctgaccgccctcaacgacatggggaaggtgcgcaaggacatccagcagtgggagccctcccggggctggaacgactggacgcaggtcccgttctgcagccaccacttccacgagctggtgatgaaggacgggcgcgtgctggtcgtgccctgccggaaccaggacgagctcatcggccgcgcgcggatctcccagggcgccgggtggagcctgaaggagaccgcctgcctgggcaagtcctacgcccagatgtggaccctcatgtacttccaccgccgggacctgcgcctggccgcgaacgccatctgcagcgccgtgccctcccactgggtccccaccagccggaccacgtggtccatccacgccaagcacgagtggatgaccaccgaggacatgctcgcggtgtggaaccgcgtgtggatccaggagaacccgtggatggaggacaagacccccgtcgagagctgggaggaggtgccctacctggggaagcgggaggaccagtggtgcggctccctgatcgggctcacgagccgcgccacctgggccaagaacatccagaccgccatcagccaggtgcggtccctgatcggcaacgaggagtacaccgactacatgcccagcatgaagcgcttccgccgggaggaggaggaggccggcgtcctgtggtga

SEQ ID NO: 9365 - RNA, 9876 nt, synthetic construct
  misc_feature 1..9876: note = derived and/or modified CDS sequence (opt1) from DENV-2__EU482561__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatgctcctggtggtcgtgtccttcgtgaccctgatcacggggaacatgagcttccgggacctcggccgcgtcatggtgatggtgggggccaccatgaccgacgacatcggcatgggcatcacctacctggccctgctcgccgcgttcaaggtccgccccacgttcgccgccgggctgctgctccggaagctgacctccaaggagctgatgatggccaccatcggcatcgccctcctgagccagtccaccatccccgagacgatcctggagctcaccgacgcgctggccctggggatgatggtgctcaagatcgtgcgcaacatggagaagtaccagctggccgtcaccatcatggccatcagctgcgtgccgaacgccgtgatcctgcagaacgcgtggaaggtctcctgcaccatcctcgccgccgtgagcgtcagccccctgctgctcacgagctcccagcagaaggccgactggatccccctggcgctgaccatcaagggcctcaaccccaccgccatcttcctgaccacgctgagccggacctccaagaagcgcagctggccgctcaacgaggccatcatggccgtgggcatggtgtccatcctggccagcagcctgctcaagaacgacatccccatgaccgggcccctggtcgcgggcgggctgctcaccgtgtgctacgtgctgacgggccggtccgccgacctggagctcgagcgcgccgccgacgtcaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtgttcccggtcagcatccccatcaccgcggccgcctggtacctctgggaggtgaagaagcagcgcgccggcgtgctgtgggacgtccccagcccgccgcccgtggggaaggccgagctggaggacggcgcgtaccggatcaagcagcgcgggatcctcggctacagccagatcggcgccggggtgtacaaggagggcaccttccacaccatgtggcacgtcacccgcggggcggtgctgatgcaccgcggcaagcggatcgagccctcctgggccgacgtgaagaaggacctgatcagctacgggggcggctggaagctcgagggggagtggaaggagggcgaggaggtccaggtgctggccctggagcccgggaagaacccccgcgcggtgcagacgaagcccggcctcttcaagaccaacaccgggaccatcggcgccgtctccctggacttcagccccggcacgtccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctgcgcaccctcatcctggccccgacccgcgtggtcgcggccgagatggaggaggccctgcgggggctccccatccgctaccagacccccgccatccgggccgagcacacgggccgcgagatcgtggacctgatgtgccacgcgaccttcaccatgcggctgctctcccccgtgcgcgtcccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggcgggcaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggggccaacttcaaggcggagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtggacgccatcgacggggagtaccggctccgcggcgaggcccggaagacgttcgtggacctgatgcgccgcggggacctgcccgtctggctcgcctaccgcgtggccgcggagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcaccctgaacctgatcaccgagatggggcggctccccacgttcatgacccagaaggcccgcgacgccctggacaacctggccgtgctccacaccgcggaggccggcgggcgggcctacaaccacgccctgtccgagctgcccgagaccctcgagacgctgctgctcctgaccctgctcgccaccgtcaccggcggcatcttcctgttcctgatgagcgggaagggcatcgggaagatgacgctcggcatgtgctgcatcatcaccgcgtccatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgccatcctgaccgtggtggcggccacgatggccaacgagatggggttcctcgagaagaccaagaaggacctgggcctgggcagcatcgccacccaggagtccgagagcaacatcctcgacatcgacctgcggccggcctccgcgtggaccctgtacgccgtcgccacgaccttcgtgacccccatgctccgccacagcatcgagaactccagcgtgaacgtctccctgaccgccatcgcgaaccaggccacggtgctgatggggctcggcaaggggtggcccctgagcaagatggacatcggcgtgcccctgctcgccatcgggtgctactcccaggtcaacccgatcaccctgaccgccgccctgctcctgctggtggcgcactacgccatcatcggccccggcctccaggccaaggccacccgggaggcccagaagcgcgcggccgccgggatcatgaagaaccccacggtggacggcatcaccgtcatcgacctggagcccatcccgtacgaccccaagttcgagaagcagctggggcaggtcatgctcctgatcctgtgcgtgacccaggtcctcatgatgcgcaccacgtgggccctgtgcgaggccctgaccctcgcgaccggccccatcagcaccctgtgggaggggaaccccggccggttctggaacacgaccatcgccgtgtccatggccaacatcttccgcggcagctacctggccggggcgggcctcctgttctccatcatgaagaacaccaccaacacgcggcgcgggaccggcaacatcggcgagaccctgggggagaagtggaagtcccggctcaacgccctgggcaagtccgagttccagatctacaagaagtccgggatccaggaggtggaccgcaccctggccaaggagggcatcaagcgcggggagacggaccaccacgccgtctcccgcggcagcgccaagctccggtggttcgtggagcgcaacatggtgaccccggagggcaaggtcgtggacctggggtgcggccgcggcgggtggtcctactactgcggcgggctgaagaacgtgcgcgaggtcaaggggctcaccaagggcgggcccgggcacgaggagcccatccccatgagcacctacggctggaacctggtgcggctgcagagcggggtggacgtcttcttcacgccgcccgagaagtgcgacaccctcctgtgcgacatcggcgagtccagccccaaccccaccatcgaggcgggccgcaccctgcgggtgctcaacctggtggagaactggctgaacaacaacacgcagttctgcatcaaggtcctcaacccgtacatgccctccgtgatcgagaagatggagaccctgcagcgcaagtacgggggcgccctggtgcggaaccccctgagccgcaactccacccacgagatgtactgggtcagcaacgccaccgggaacatcgtgtccagcgtgaacatgatctcccggatgctcatcaaccgcttcaccatgaagcacaagaaggccacgtacgagccggacgtcgacctgggcagcgggacccgcaacatcggcatcgagtccgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcgtccagcatggtgaacggggtggtccgcctcctgaccaagccctgggacgtggtgccgatggtcacccagatggccatgacggacaccacccccttcggccagcagcgggtgttcaaggagaaggtggacacccgcacgcaggagcccaaggagggcaccaagaagctgatgaagatcaccgccgagtggctctggaaggagctggggaagaagaagacgccccggatgtgcacgcgcgaggagttcacccggaaggtccgctccaacgccgccctgggcgcgatcttcaccgacgagaacaagtggaagtccgcccgggaggccgtggaggactcccgcttctgggagctcatcgaccgggagcgcaacctgcacctggaggggaagtgcgagacctgcgtgtacaacatgatgggcaagcgggagaagaagctcggggagttcggcaaggccaagggcagccgcgcgatctggtacatgtggctgggggcccggttcctggagttcgaggccctcggcttcctgaacgaggaccactggttcagccgcgggaactccctgagcggcgtcgagggggagggcctccaccggctgggctacatcctgcgcgacgtgtccaagaaggagggcggggccatgtacgccgacgacacggcggggtgggacacccggatcaccctcgaggacctgaagaacgaggagatggtcaccaaccacatgaagggcgagcacaagaagctggccgaggccatcttcaagctcacgtaccagaacaaggtggtgcgcgtccagcggccgacgccccgggggaccgtgatggacatcatcagccgccgggaccagcgcggctccggccaggtggggacctacggcctgaacacgttcaccaacatggaggcccagctgatccggcagatggagggggagggcatcttcaagagcatccagcacctcaccgtcaccgaggagatcgccgtgcagaactggctggcgcgcgtgggccgggagcgcctgtcccggatggccatcagcggggacgactgcgtcgtgaagcccctcgacgaccgcttcgcctccgccctgacggccctgaacgacatgggcaaggtgcggaaggacatccagcagtgggagcccagccgcgggtggaacgactggacccaggtcccgttctgctcccaccacttccacgagctcatcatgaaggacggccgggtgctggtggtcccctgccgcaaccaggacgagctgatcgggcgggcgcgcatcagccagggcgccggctggtccctcaaggagaccgcctgcctgggcaagagctacgcccagatgtggaccctgatgtacttccaccggcgcgacctccggctggccgcgaacgccatctgctccgccgtgcccagccactgggtgcccacgtcccgcaccacctggagcatccacgccaagcacgagtggatgaccaccgaggacatgctggcggtctggaaccgggtgtggatccaggagaacccgtggatggaggacaagacgcccgtggagagctgggaggaggtcccctacctcggcaagcgcgaggaccagtggtgcgggtccctgatcggcctgaccagccgcgccacctgggccaagaacatccagaccgccatcaaccaggtgcggtccctcatcgggaacgaggagtacacggactacatgcccagcatgaagcgcttccggcgcgaggaggaggaggccggcgtgctgtggtga

SEQ ID NO: 9366 - RNA, 9876 nt, synthetic construct
  misc_feature 1..9876: note = derived and/or modified CDS sequence (opt1) from DENV-2__EU569703__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcgggccgccgccgggatcatgaagaaccccaccgtggacggcatcaccgtgatcgacctcgagcccatcccgtacgaccccaagttcgagaagcagctggggcaggtcatgctgctcgtgctgtgcgtgacccaggtcctgatgatgcgcacgacctgggcgctctgcgaggccctgaccctggccaccggccccatcagcacgctctgggaggggaaccccggccggttctggaacaccaccatcgccgtgtccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacgtacggctggaacctcgtgcggctgcagagcggggtggacgtcttcttcaccccgcccgagaagtgcgacaccctgctctgcgacatcggcgagtccagccccaaccccaccatcgaggccggccgcacgctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcacgatgaagcacaagaaggcgacctacgagccggacgtcgacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtggtccgcctgctcaccaagccctgggacgtggtgccgatggtcacgcagatggccatgaccgacaccacccccttcggccagcagcgggtgttcaaggagaaggtggacacgcgcacccaggagcccaaggagggcaccaagaagctgatgcggatcaccgccgagtggctgtggaaggagctcgggaagaagaagacgccccgcatgtgcacccgggaggagttcacccgcaaggtccggagcaacgcggccctgggcgccatcttcaccgacgagaacaagtggaagtccgcccgcgaggccgtggaggacagccggttctgggagctggtcgaccgcgagcggaacctccacctggaggggaagtgcgagacgtgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaacagcctgtccggcgtggagggggagggcctgcacaagctcggctacatcctgcgcgacgtcagcaagaaggagggcggcgcgatgtacgccgacgacaccgccgggtgggacacccggatcaccctggaggacctcaagaacgaggagatggtgacgaaccacatgaagggcgagcacaagaagctggccgaggccatcttcaagctgacctaccagaacaaggtggtccgcgtgcagcgcccgacgccccgggggaccgtgatggacatcatctcccgcaaggaccagcggggcagcggccaggtcgggacgtacggcctcaacaccttcaccaacatggaggcgcagctgatccgccagatggagggggagggcatcttcaagtccatccagcggctgaccgtgacggaggagatcgccgtgcagaactggctcgcccgcgtcggccgggagcgcctgagccggatggccatctccggggacgactgcgtggtgaagcccctggacgaccgcttcgccagcgcgctcaccgccctgaacgacatgggcaaggtccggaaggacatccagcagtgggagccctcccgcgggtggaacgactggacccaggtgccgttctgcagccaccacttccacgagctggtgatgaaggacggccgggtcctcgtggtgccctgccgcaaccaggacgagctgatcgggcgggcccgcatctcccagggcgccggctggagcctgaaggagaccgcctgcctcgggaagtcctacgcgcagatgtggacgctgatgtacttccaccggcgcgacctgcggctcgccgccaacgccatctgcagcgccgtcccctcccactgggtgcccaccagccgcaccacctggtccatccacgcgaagcacgagtggatgaccacggaggacatgctggccgtgtggaaccgcgtctggatccaggagaacccgtggatggaggacaagacccccgtggagagctgggaggaggtgccctacctgggcaagcgggaggaccagtggtgcgggagcctcatcggcctgacctcccgcgccacctgggccaagaacatccagacggcgatcaaccaggtccggagcctgatcgggaacgaggagtacaccgactacatgccctccatgaagcgcttccggaaggaggaggaggaggccggcgtgctctggtga

SEQ ID NO: 9367 - RNA, 9876 nt, synthetic construct
  misc_feature 1..9876: note = derived and/or modified CDS sequence (opt1) from DENV-2__EU529694__SS-prME
  source 1..9876: mol_type = other RNA
accgccggcgtcttcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatgctcctggtggccgtctccttcgtgaccctgatcacggggaacatgagcttccgggacctcggccgcgtgatggtcatggtgggggccaccatgaccgacgacatcggcatgggcatcacctacctggccctgctcgcggccttcaaggtgcgccccacgttcgccgccgggctgctgctccggaagctgacctccaaggagctgatgatggccaccatcggcatcgcgctcctgagccagtccaccatccccgagacgatcctggagctcaccgacgccctggccctggggatgatggtcctcaagatcgtgcgcaacatggagaagtaccagctggccgtgaccatcatggccatcagctgcgtcccgaacgcggtgatcctgcagaacgcctggaaggtgtcctgcaccatcctcgccgccgtcagcgtgagccccctgctgctcacgagctcccagcagaaggcggactggatccccctggccctgaccatcaagggcctcaaccccaccgccatcttcctgaccacgctgagccggacctccaagaagcgcagctggccgctcaacgaggccatcatggccgtcggcatggtgtccatcctggcgagcagcctgctcaagaacgacatccccatgaccgggcccctggtggccggcgggctgctcaccgtctgctacgtgctgacgggccggtccgccgacctggagctcgagcgcgccgccgacgtgaagtgggaggaccaggcggagatcagcgggtccagccccatcctgtccatcaccatcagcgaggacggctccatgagcatcaagaacgaggaggaggagcagaccctgaccatcctcatccggacgggcctgctggtcatctccggggtgttcccggtgagcatccccatcaccgccgccgcctggtacctctgggaggtcaagaagcagcgcgccggcgtgctgtgggacgtgcccagcccgccgcccgtcgggaaggcggagctggaggacggcgcctaccggatcaagcagcgcgggatcctcggctacagccagatcggcgccggggtgtacaaggagggcaccttccacaccatgtggcacgtgacccgcggggcggtcctgatgcaccgcggcaagcggatcgagccctcctgggccgacgtgaagaaggacctgatcagctacgggggcggctggaagctcgagggggagtggaaggagggcgaggaggtgcaggtcctggcgctggagcccgggaagaacccccgcgccgtgcagacgaagcccggcctcttcaagaccaacaccgggaccatcggcgccgtgtccctggacttcagccccggcacgtccgggagccccatcgtcgaccggaagggcaaggtggtggggctgtacggcaacggcgtcgtgacccgctccggggcctacgtgagcgcgatcgcccagaccgagaagtccatcgaggacaaccccgagatcgaggacgacatcttccggaagaagcgcctcaccatcatggacctgcaccccggcgccgggaagacgaagcggtacctgcccgccatcgtccgcgaggccatcaagcggggcctgcgcaccctcatcctggcgccgacccgcgtggtggccgccgagatggaggaggccctgcgggggctccccatccgctaccagacccccgccatccgggcggagcacacgggccgcgagatcgtcgacctgatgtgccacgccaccttcaccatgcggctgctctcccccgtgcgcgtgccgaactacaacctgatcatcatggacgaggcccacttcaccgaccccgccagcatcgccgcgcggggctacatctccacgcgcgtcgagatgggggaggccgccggcatcttcatgaccgccacgccgcccgggagccgggacccgttcccccagtccaacgcgcccatcatggacgaggagcgcgagatccccgagcggagctggaactccggccacgagtgggtgaccgacttcaaggggaagacggtgtggttcgtcccgagcatcaaggccggcaacgacatcgccgcctgcctgcgcaagaacggcaagaaggtgatccagctctcccggaagaccttcgacagcgagtacgtgaagacccgcgccaacgactgggacttcgtcgtgaccacggacatctccgagatgggggcgaacttcaaggccgagcgggtgatcgacccccgccggtgcatgaagcccgtcatcctgaccgacggcgaggagcgcgtgatcctggccgggcccatgccggtgacccacagctccgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgcgagaaggtcgacgccatcgacggggagtaccggctccgcggcgaggcccggaagacgttcgtggacctgatgcgccgcggggacctgcccgtgtggctcgcctaccgcgtcgcggccgagggcatcaactacgccgaccggcgctggtgcttcgacgggatcaagaacaaccagatcctggaggagaacgtggaggtggagatctggaccaaggagggcgagcggaagaagctgaagccgcgctggctcgacgcccggatctactccgaccccctggcgctgaaggagttcaaggagttcgccgccggccgcaagagcctcaccctgaacctgatcaccgagatggggcggctccccacgttcatgacccagaaggcccgcgacgccctggacaacctggcggtcctccacaccgccgaggccggcgggcgggcctacaaccacgccctgtccgagctgcccgagaccctcgagacgctgctgctcctgaccctgctcgcgaccgtgaccggcggcatcttcctgttcctgatgagcgggaagggcatcgggaagatgacgctcggcatgtgctgcatcatcaccgcctccatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgcgatcctgaccgtcgtggccgccacgatggccaacgagatggggttcctcgagaagaccaagaaggacctgggcctgggcagcatcgccacccaggagtccgagagcaacatcctcgacatcgacctgcggccggcgtccgcctggaccctgtacgccgtggccacgaccttcgtcacccccatgctccgccacagcatcgagaactccagcgtgaacgtgtccctgaccgcgatcgccaaccaggccacggtcctgatggggctcggcaaggggtggcccctgagcaagatggacatcggcgtgcccctgctcgccatcgggtgctactcccaggtgaacccgatcaccctgaccgccgcgctgctcctgctggtcgcccactacgccatcatcggccccggcctccaggccaaggccacccgggaggcgcagaagcgcgccgccgccgggatcatgaagaaccccacggtggacggcatcaccgtgatcgacctggagcccatcccgtacgaccccaagttcgagaagcagctggggcaggtcatgctcctgatcctgtgcgtgacccaggtgctcatgatgcgcaccacgtgggccctgtgcgaggcgctgaccctcgccaccggccccatcagcaccctgtgggaggggaaccccggccggttctggaacacgaccatcgccgtctccatggccaacatcttccgcggcagctacctggcgggggccggcctcctgttctccatcatgaagaacaccaccaacacgcggcgcgggaccggcaacatcggcgagaccctgggggagaagtggaagtcccggctcaacgccctgggcaagtccgagttccagatctacaagaagtccgggatccaggaggtggaccgcaccctggccaaggagggcatcaagcgcggggagacggaccaccacgccgtgtcccgcggcagcgcgaagctccggtggttcgtcgagcgcaacatggtgaccccggagggcaaggtggtcgacctggggtgcggccgcggcgggtggtcctactactgcggcgggctgaagaacgtgcgcgaggtgaaggggctcaccaagggcgggcccgggcacgaggagcccatccccatgagcacctacggctggaacctggtccggctgcagagcggggtggacgtgttcttcacgccgcccgagaagtgcgacaccctcctgtgcgacatcggcgagtccagccccaaccccaccatcgaggccggccgcaccctgcgggtcctcaacctggtggagaactggctgaacaacaacacgcagttctgcatcaaggtgctcaacccgtacatgccctccgtcatcgagaagatggagaccctgcagcgcaagtacgggggcgccctggtgcggaaccccctgagccgcaactccacccacgagatgtactgggtgagcaacgccaccgggaacatcgtctccagcgtgaacatgatctcccggatgctcatcaaccgcttcaccatgaagcacaagaaggccacgtacgagccggacgtggacctgggcagcgggacccgcaacatcggcatcgagtccgagatccccaacctggacatcatcggcaagcggatcgagaagatcaagcaggagcacgagaccagctggcactacgaccaggaccacccctacaagacctgggcgtaccacgggtcctacgagacgaagcagaccggcagcgcctccagcatggtcaacggggtggtgcgcctcctgaccaagccctgggacgtcgtgccgatggtgacccagatggccatgacggacaccacccccttcggccagcagcgggtcttcaaggagaaggtggacacccgcacgcaggagcccaaggagggcaccaagaagctgatgaagatcaccgccgagtggctctggaaggagctggggaagaagaagacgccccggatgtgcacgcgcgaggagttcacccggaaggtgcgctccaacgccgcgctgggcgccatcttcaccgacgagaacaagtggaagtccgcccgggaggccgtcgaggactcccgcttctgggagctcatcgaccgggagcgcaacctgcacctggaggggaagtgcgagacctgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttcagccgcgggaactccctgagcggcgtggagggggagggcctccaccggctgggctacatcctgcgcgacgtctccaagaaggagggcggggccatgtacgcggacgacacggccgggtgggacacccggatcaccctcgaggacctgaagaacgaggagatggtgaccaaccacatgaagggcgagcacaagaagctggccgaggccatcttcaagctcacgtaccagaacaaggtcgtgcgcgtgcagcggccgacgccccgggggaccgtcatggacatcatcagccgccgggaccagcgcggctccggccaggtggggacctacggcctgaacacgttcaccaacatggaggcccagctgatccggcagatggagggggagggcatcttcaagagcatccagcacctcaccgtgaccgaggagatcgcggtccagaactggctggcccgcgtgggccgggagcgcctgtcccggatggccatcagcggggacgactgcgtggtcaagcccctcgacgaccgcttcgcctccgccctgacggcgctgaacgacatgggcaaggtgcggaaggacatccagcagtgggagcccagccgcgggtggaacgactggacccaggtgccgttctgctcccaccacttccacgagctcgtcatgaaggacggccgggtgctggtggtcccctgccgcaaccaggacgagctgatcgggcgggcccgcatcagccagggcgccggctggtccctcaaggagaccgcctgcctgggcaagagctacgcccagatgtggaccctgatgtacttccaccggcgcgacctccggctggcggccaacgccatctgctccgccgtgcccagccactgggtgcccacgtcccgcaccacctggagcatccacgcgaagcacgagtggatgaccaccgaggacatgctggccgtctggaaccgggtgtggatccaggagaacccgtggatggaggacaagacgcccgtggagagctgggaggaggtcccctacctcggcaagcgcgaggaccagtggtgcgggtccctgatcggcctgaccagccgcgccacctgggccaagaacatccagaccgccatcaaccaggtgcggtccctcatcgggaacgaggagtacacggactacatgcccagcatgaagcgcttccggcgcgaggaggaggaggcgggcgtgctgtggtga

SEQ ID NO: 9368 - RNA, 9876 nt, synthetic construct
  misc_feature 1..9876: note = derived and/or modified CDS sequence (opt1) from DENV-2__EU529695__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcatcacccaggagtccgagagcaacatcctggacatcgacctccgcccggcctccgcctggaccctgtacgccgtggccacgaccttcgtcacccccatgctgcggcacagcatcgagaactccagcgtgaacgtgtccctcaccgcgatcgccaaccaggccacggtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacccgcgaggcccagaagcgggccgccgccgggatcatgaagaaccccacggtggacggcatcaccgtgatcgacctcgagcccatcccgtacgaccccaagttcgagaagcagctggggcaggtcatgctgctcgtgctgtgcgtgacccaggtcctgatgatgcgcaccacgtgggcgctctgcgaggccctgaccctggccaccggccccatcagcaccctctgggaggggaaccccggccggttctggaacacgaccatcgccgtgtccatggccaacatcttccgcggcagctacctggcgggggccggcctcctcttctccatcatgaagaacaccaccaacacgcggcgcgggaccggcaacatcggcgagaccctgggggagaagtggaagtcccggctgaacgccctcggcaagtccgagttccagatctacaagaagtccgggatccaggaggtggaccgcaccctggccaaggagggcatcaagcgcggggagacggaccaccacgcggtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacctacggctggaacctcgtgcggctgcagagcggggtggacgtcttcttcacgccgcccgagaagtgcgacaccctgctctgcgacatcggcgagtccagccccaaccccaccatcgaggccggccgcaccctgcgggtgctgaacctcgtggagaactggctgaacaacaacacgcagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcaccatgaagcacaagaaggcgacgtacgagccggacgtcgacctcggcagcgggacccgcaacatcggcatcgagaacgagatccccaacctggacatcatcggcaagcggatcgagaagatcaagcaggagcacgagacctcctggcactacgaccaggaccacccctacaagacctgggcctaccacgggagctacgagacgaagcagaccggctccgccagctccatggtgaacggggtggtccgcctgctcaccaagccctgggacgtggtgccgatggtcacccagatggccatgacggacaccacccccttcggccagcagcgggtgttcaaggagaaggtggacacccgcacgcaggagcccaaggagggcaccaagaagctgatgcggatcaccgccgagtggctgtggaaggagctcgggaagaagaagacgccccggatgtgcacgcgggaggagttcacccgcaaggtccggagcaacgcggccctgggcgccatcttcaccgacgagaacaagtggaagtccgcccgcgaggccgtggaggacagccggttctgggagctggtcgaccgcgagcggaacctccacctggaggggaagtgcgagacctgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaacagcctgtccggcgtggagggggagggcctgcacaagctcggctacatcctgcgcgacgtcagcaagaaggagggcggcgcgatgtacgccgacgacacggccgggtgggacacccggatcaccctggaggacctcaagaacgaggagatggtgaccaaccacatgaagggcgagcacaagaagctggccgaggccatcttcaagctgacgtaccagaacaaggtggtccgcgtgcagcgcccgacgccccgggggaccgtgatggacatcatctcccgcaaggaccagcggggcagcggccaggtcgggacctacggcctcaacacgttcaccaacatggaggcgcagctgatccgccagatggagggggagggcatcttcaagtccatccagcacctgaccgtgaccgaggagatcgccgtgcagaactggctcgcccgggtcggccgcgagcggctgagccgcatggccatctccggggacgactgcgtggtgaagcccctggacgaccggttcgccagcgcgctcacggccctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgccggctggagcctgaaggagaccgcctgcctcgggaagtcctacgcgcagatgtggaccctgatgtacttccaccgccgggacctgcgcctcgccgccaacgccatctgcagcgccgtcccctcccactgggtgcccacgagccggaccacctggtccatccacgcgaagcacgagtggatgaccaccgaggacatgctggccgtgtggaaccgcgtctggatccaggagaacccgtggatggaggacaagacgcccgtggagagctgggaggaggtgccctacctgggcaagcgcgaggaccagtggtgcgggagcctcatcggcctgacctcccgggccacctgggccaagaacatccagaccgcgatcaaccaggtccgcagcctgatcgggaacgaggagtacacggactacatgccctccatgaagcggttccgcaaggaggaggaggaggccggcgtgctctggtga

SEQ ID NO: 9369 - RNA, 9876 nt, synthetic construct
  misc_feature 1..9876: note = derived and/or modified CDS sequence (opt1) from DENV-2__EU482562__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgatcctgtacctcggggccatggtccaggcggactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggccggcaagcggtccctgcgcccgcagcccaccgagctcaagtacagctggaagacctggggcaaggcgaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgccatcaaggacaaccgggcggtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgcggggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgcgatcctcctggtggccgtctccttcgtgaccctgatcacggggaacatgagcttccgggacctcggccgcgtgatggtcatggtgggggccaccatgaccgacgacatcggcatgggcgtgacctacctggccctgctcgccgcgttcaaggtccgccccacgttcgccgccgggctgctgctccggaagctgacctccaaggagctgatgatggccaccatcggcatcgccctcctgagccagtccaccatccccgagacgatcctggagctcaccgacgcgctggccctggggatgatggtgctcaagatcgtgcgcaacatggagaagtaccagctggccgtcaccatcatggccatcagctgcgtgccgaacgccgtgatcctgcagaacgcgtggaaggtctcctgcaccatcctcgccgccgtgagcgtcagccccctgctgctcacgagctcccagcagaaggccgactggatccccctggcgctgaccatcaagggcctcaaccccaccgccatcttcctgaccacgctgagccggacctccaagaagcgcagctggccgctcaacgaggccatcatggccgtgggcatggtgtccatcctggccagcagcctgctcaagaacgacatccccatgaccgggcccctggtcgcgggcgggctgctcaccgtgtgctacgtgctgacgggccggtccgccgacctggagctcgagcgcgccgccgacgtcaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtgttcccggtcagcatccccatcaccgcggccgcctggtacctctgggaggtgaagaagcagcgcgccggcgtgctgtgggacgtccccagcccgccgcccgtggggaaggccgagctggaggacggcgcgtaccggatcaagcagcgcgggatcctcggctacagccagatcggcgccggggtgtacaaggagggcaccttccacaccatgtggcacgtcacccgcggggccgtgctgatgcaccgcggcaagcggatcgagccctcctgggccgacgtgaagaaggacctgatcagctacgggggcggctggaagctcgagggggagtggaaggagggcgaggaggtccaggtgctggccctggagcccgggaagaacccccgcgcggtgcagacgaagcccggcctcttcaagaccaacaccgggaccatcggcgccgtctccctggacttcagccccggcacgtccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctgcgcaccctcatcctggccccgacccgcgtggtcgcggccgagatggaggaggccctgcgggggctccccatccgctaccagacccccgccatccgggccgagcacacgggccgcgagatcgtggacctgatgtgccacgcgaccttcaccatgcggctgctctcccccgtgcgcgtcccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggcgggcaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggggccaacttcaaggcggagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtggacgccatcgacggggagtaccggctccgcggcgaggcccggaagacgttcgtggacctgatgcgccgcggggacctgcccgtctggctcgcctaccgcgtggccgcggagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcaccctgaacctgatcaccgagatggggcggctccccacgttcatgacccagaaggcccgcgacgccctggacaacctggccgtgctccacaccgcggaggccggcgggcgggcctacaaccacgccctgtccgagctgcccgagaccctcgagacgctgctgctcctgaccctgctcgccaccgtcaccggcggcatcttcctgttcctgatgagcgggaagggcatcgggaagatgacgctcggcatgtgctgcatcatcaccgcgtccatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgccatcctgaccgtggtggcggccacgatggccaacgagatggggttcctcgagaagaccaagaaggacctgggcctgggcagcatcaccacccaggagtccgagagcaacatcctcgacatcgacctgcggccggcctccgcctggacgctgtacgcggtcgccaccaccttcgtgacccccatgctccgccacagcatcgagaactccagcgtgaacgtctccctgacggccatcgccaaccaggcgaccgtgctgatggggctcggcaaggggtggcccctgagcaagatggacatcggcgtgcccctgctcgccatcgggtgctactcccaggtcaacccgatcaccctgaccgccgccctgctcctgctggtggcccactacgcgatcatcggccccggcctccaggccaaggccacgcgggaggcccagaagcgcgccgcggccgggatcatgaagaaccccaccgtggacggcatcaccgtcatcgacctggagcccatcccgtacgaccccaagttcgagaagcagctggggcaggtcatgctcctgatcctgtgcgtgacccaggtcctcatgatgcgcacgacctgggccctgtgcgaggccctgaccctcgccaccggccccatcagcacgctgtgggaggggaaccccggccggttctggaacaccaccatcgcggtgtccatggccaacatcttccgcggcagctacctggccggggccggcctcctgttctccatcatgaagaacaccacgaacacccggcgcgggaccggcaacatcggcgagaccctgggggagaagtggaagtcccggctcaacgcgctgggcaagtccgagttccagatctacaagaagtccgggatccaggaggtggaccgcacgctggccaaggagggcatcaagcgcggggagaccgaccaccacgccgtctcccgcggcagcgccaagctccggtggttcgtggagcgcaacatggtgaccccggagggcaaggtcgtggacctggggtgcggccgcggcgggtggtcctactactgcggcgggctgaagaacgtgcgcgaggtcaaggggctcaccaagggcgggcccgggcacgaggagcccatccccatgagcacgtacggctggaacctggtgcggctgcagagcggggtggacgtcttcttcaccccgcccgagaagtgcgacaccctcctgtgcgacatcggcgagtccagccccaaccccaccatcgaggccggccgcacgctgcgggtgctcaacctggtggagaactggctgaacaacaacacccagttctgcatcaaggtcctcaacccgtacatgccctccgtgatcgagaagatggagaccctgcagcgcaagtacgggggcgcgctggtgcggaaccccctgagccgcaactccacccacgagatgtactgggtcagcaacgccaccgggaacatcgtgtccagcgtgaacatgatctcccggatgctcatcaaccgcttcacgatgaagcacaagaaggccacctacgagccggacgtcgacctgggcagcgggacccgcaacatcggcatcgagtccgagatccccaacctggacatcatcggcaagcggatcgagaagatcaagcaggagcacgagaccagctggcactacgaccaggaccacccctacaagacgtgggcctaccacgggtcctacgagaccaagcagaccggcagcgcctccttcatggtgaacggggtggtccgcctcctgaccaagccctgggacgtggtgccgatggtcacgcagatggcgatgaccgacaccacccccttcggccagcagcgggtgttcaaggagaaggtggacacgcgcacccaggagcccaaggagggcaccaagaagctgatgaagatcaccgccgagtggctctggaaggagctggggaagaagaagacgccccggatgtgcacccgcgaggagttcacccggaaggtccgcagcaacgccgccctgggcgccatcttcaccgacgagaacaagtggaagtccgcgcgggaggccgtggaggacagccgcttctgggagctcatcgaccgggagcgcaacctgcacctggaggggaagtgcgagacgtgcgtgtacaacatgatgggcaagcgggagaagaagctcggggagttcggcaaggccaagggctcccgcgccatctggtacatgtggctgggggcgcggttcctggagttcgaggccctcggcttcctgaacgaggaccactggttcagccgcgggaacagcctgtccggcgtcgagggggagggcctccaccggctgggctacatcctgcgcgacgtgagcaagaaggagggcggcgccatgtacgccgacgacaccgccgggtgggacacccggatcaccctcgaggacctgaagaacgaggagatggtcacgaaccacatgaagggcgagcacaagaagctggcggaggccatcttcaagctcacctaccagaacaaggtggtgcgcgtccagcggccgacgccccgggggaccgtgatggacatcatctcccgccgggaccagcgcggcagcggccaggtggggacgtacggcctgaacaccttcaccaacatggaggcccagctgatccggcagatggagggggagggcatcttcaagtccatccagcacctcaccgtcacggaggagatcgccgtgcagaactggctggcccgcgtgggccgggagcgcctgagccggatggcgatctccggggacgactgcgtcgtgaagcccctcgacgaccgcttcgccagcgccctgaccgccctgaacgacatgggcaaggtgcggaaggacatccagcagtgggagccctcccgcgggtggaacgactggacccaggtcccgttctgcagccaccacttccacgagctcgtgatgaaggacggccgggtgctggtcgtgccctgccgcaaccaggacgagctgatcgggcgggcccgcatctcccagggcgcgggctggagcctcaaggagaccgcctgcctggggaagtcctacgcccagatgtggacgctgatgtacttccaccggcgcgacctccggctggccgccaacgcgatctgcagcgccgtgccctcccactgggtccccaccagccgcaccacctggtccatccacgccaagcacgagtggatgaccacggaggacatgctggccgtgtggaaccgggtgtggatccaggagaacccgtggatggaggacaagacccccgtcgagagctgggaggaggtgccctacctcggcaagcgcgaggaccagtggtgcgggagcctgatcggcctgacctcccgcgcgacctgggccaagaacatccagacggccatcaaccaggtgcggagcctcatcgggaacgaggagtacaccgactacatgccctccatgaagcgcttccggcgcgaggaggaggaggccggcgtcctgtggtga

SEQ ID NO: 9370 - RNA, 9876 nt, synthetic construct
  misc_feature 1..9876: note = derived and/or modified CDS sequence (opt1) from DENV-2__EU482565__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccaccccggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggcagctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgccccacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacatcctggggcgcctgatcaccgtcaacccgatcgtgaccgagaaggacagccccgtgaacatcgaggcggagccgcccttcggcgactcctacatcatcatcggggtcgagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtgttcggcgcgatctacggcgccgccttcagcggggtctcctggaccatgaagatcctgatcggcgtgatcatcacgtggatcgggatgaacagccgctccaccagcctgtccgtgagcctcgtcctggtgggcgtggtcaccctgtacctcggggtgatggtgcaggccgactccggctgcgtcgtgagctggaagaacaaggagctgaagtgcggctccgggatcttcatcaccgacaacgtgcacacgtggaccgagcagtacaagttccagcccgagtccccgcccaagctggcgagcgccatccagaaggcccacgaggagggcatctgcgggatccggtccgtcacccgcctcgagaacctgatgtggaagcagatcaccccggagctgaaccacatcctcagcgagaacgaggtgaagctgacgatcatgaccggcgacatcaaggggatcatgcaggccggcaagcggtccctgcgcccccagcccaccgagctcaagtacagctggaagacctggggcaaggccaagatgctgtccacggagagccacaaccagaccttcctgatcgacgggccggagaccgcggagtgccccaacaccaaccgggcctggaactccctcgaggtggaggactacggcttcggggtcttcagcacgaacatctggctgaagctgcgcgagaagcaggacgtgttctgcgactccaagctcatgagcgccgccatcaaggacaaccgggccgtgcacgcggacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgccgggccggtgtcccagcacaactaccgccccggctaccacacccagaccgccgggccctggcacctgggcaagctggagatggacttcgacttctgcgaggggacgaccgtcgtggtgaccgaggactgcggcaaccggggccccagcctccgcaccacgaccgcgagcgggaagctgatcaccgagtggtgctgccggtcctgcaccctgccgcccctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggcggtgagcttcgtcaccctgatcacggggaacatgtccttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgaccagcaaggagctgatgatggccaccatcggcatcgccctcctgtcccagagcaccatcccggagacgatcctggagctcaccgacgccctggcgctggggatgatggtcctcaagatcgtgcgcaacatggagaagtaccagctggccgtgaccatcatggccatctcctgcgtccccaacgccgtgatcctgcagaacgcctggaaggtgagctgcaccatcctcgcggccgtctccgtgagccccctgctgctcacgtccagccagcagaaggccgactggatccccctggccctgaccatcaagggcctcaacccgaccgcgatcttcctgaccacgctgtcccggaccagcaagaagcgctcctggcccctcaacgaggccgtcatggccgtgggcatggtgagcatcctggcctccagcctgctcaagaacgacatccccatgaccgggcccctggtcgccggcgggctgctcaccgtgtgctacgtgctgacgggccggagcgcggacctggagctcgagcgcgccgccgacgtcaagtgggaggaccaggccgagatctccgggagctccccgatcctgagcatcaccatctccgaggacggcagcatgtccatcaagaacgaggaggaggagcacaccctgaccatcctcatccggacgggcctgctggtgatcagcggggtgttccccgtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctactcccagatcggcgcgggggtgtacaaggagggcaccttccacaccatgtggcacgtcacccgcggggccgtgctcatgcaccgcggcaagcggatcgagccgagctgggccgacgtgaagaaggacctgatctcctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgcggtcagcctcgacttctccccgggcacgagcgggtcccccatcgtggaccggaagggcaaggtggtcgggctgtacggcaacggcgtggtgacccgcagcggggcctacgtctccgccatcgcccagaccgagaagtccatcgaggacaaccccgagatcgaggacgacatcttccggaagaagcgcctgaccatcatggacctccaccccggcgcggggaagacgaagcggtacctgccggccatcgtgcgcgaggccatcaagcggggcctgcgcaccctgatcctcgcccccacccgcgtggtcgccgcggagatggaggaggccctgcgggggctgcccatccgctaccagacccccgccatccgggccgagcacacgggccgcgagatcgtggacctcatgtgccacgccaccttcaccatgcggctgctgagcccggtgcgcgtccccaactacaacctcatcatcatggacgaggcgcacttcaccgaccccgcctccatcgccgcccggggctacatcagcacgcgcgtggagatgggggaggccgcgggcatcttcatgaccgccacgccgcccgggtcccgggaccccttcccccagagcaacgcccccatcatggacgaggagcgcgagatccccgagcggtcctggaacagcggccacgagtgggtgaccgacttcaaggggaagacggtctggttcgtgccctccatcaaggccggcaacgacatcgcggcctgcctgcgcaagaacggcaagaaggtgatccagctgagccggaagaccttcgactccgagtacgtcaagacccgcgccaacgactgggacttcgtggtgaccacggacatcagcgagatgggggccaacttccgggccgagcgcgtcatcgacccccggcgctgcatgaagcccgtgatcctcaccgacggcgaggagcgggtgatcctggcggggccgatgcccgtcacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacaccccggagggcatcatcccctccatgttcgagcccgagcgggagaaggtggacgcgatcgacggggagtaccgcctgcggggcgaggcccgcaagacgttcgtggacctcatgcggcgcggggacctgccggtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccccggtggctggacgcccgcatctacagcgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggtcggcgggcgcgcgtacaaccacgccctcagcgagctgccggagaccctggagacgctcctgctgctcaccctgctggccaccgtgaccggcggcatcttcctcttcctgatgtccgggaagggcatcgggaagatgacgctgggcatgtgctgcatcatcaccgccagcatcctcctgtggtacgcccagatccagccccactggatcgcggcctccatcatcctggagttcttcctcatcgtgctgctgatccccgagcccgagaagcagcggaccccgcaggacaaccagctcacctacgtcgtgatcgccatcctgaccgtggtcgccgccacgatggcgaacgagatggggttcctggagaagaccaagaaggacctcggcctgggcagcatcaccacccaggagcccgagagcaacatcctggacatcgacctccgccccgcctccgcctggacgctgtacgccgtggccaccaccttcgtgacccccatgctgcggcacagcatcgagaactccagcgtcaacgtgtccctcacggcgatcgccaaccaggccaccgtgctgatggggctgggccgcgggtggccgctcagcaagatggacatcggcgtccccctgctggccatcgggtgctactcccaggtgaaccccatcaccctcaccgcggccctgctgctcctggtggcccactacgccatcatcggccccggcctgcaggccaaggcgacgcgcgaggcccagaagcgggccgccgccgggatcatgaagaacccgaccgtcgacggcatcaccgtgatcgacctcgagcccatcccctacgaccccaagttcgagaagcagctgggccaggtgatgctgctcgtcctgtgcgtgacccaggtgctgatgatgcgcacgacctgggcgctctgcgaggccctgaccctggccaccggcccgatcagcacgctctgggaggggaaccccggccggttctggaacaccaccatcgccgtctccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtgtcccgcggcagcgccaagctgcggtggttcgtcgagcgcaacatggtgacccccgagggcaaggtggtcgacctcgggtgcggccgcggcgggtggtcctactactgcggcgggctgaagaacgtgcgcgaggtgaaggggctgaccaagggcgggcccgggcacgaggagccgatccccatgagcacgtacggctggaacctcgtccggctgcagtccggggtggacgtgttcttcacgccgcccgagaagtgcgacaccctgctctgcgacatcggcgagagcagcccgaaccccaccatcgaggccggccgcacgctgcgggtcctgaacctcgtggagaactggctgaacaacaacacccagttctgcatcaaggtgctgaacccctacatgccgtccgtcatcgagaagatggagaccctccagcgcaagtacgggggcgccctggtgcggaaccccctgagccgcaactccacccacgagatgtactgggtgagcaacgccaccgggaacatcgtctccagcgtgaacatgatctcccgcatgctgatcaaccggttcacgatgaagcacaagaaggcgacctacgagcccgacgtggacctcggcagcgggacccgcaacgtcggcatcgagaacgagatccccaacctggacatcatcggcaagcggatcgagaagatcaagcaggagcacgagacctcctggcactacgaccaggaccacccgtacaagacgtgggcctaccacgggagctacgagaccaagcagaccggctccgccagctccatggtgaacggggtggtccgcctgctcaccaagccctgggacgtggtgcccatggtcacgcagatggccatgaccgacaccacccccttcggccagcagcgggtgttcaaggagaaggtggacacgcgcacccaggagccgaaggagggcaccaagaagctgatgcggatcaccgccgagtggctgtggaaggagctcgggaagaagaagacgccccgcatgtgcacccgggaggagttcacccgcaaggtccggagcaacgcggccctgggcgccatcttcaccgacgagaacaagtggaagtccgcccgcgaggccgtggaggacagccggttctgggagctggtcgaccgcgagcggaacctccacctggaggggaagtgcgagacgtgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaactccctgagcggcgtggagggggagggcctgcacaagctcggctacatcctgcgcgacgtcagcaagaaggagggcggggcgatgtacgccgacgacaccgccgggtgggacacccggatcaccctggaggacctcaagaacgaggagatggtgacgaaccacatgaagggcgagcacaagaagctggccgaggccatcttcaagctgacctaccagaacaaggtggtccgcgtgcagcgccccacgccccgggggaccgtgatggacatcatctcccgcaaggaccagcggggcagcggccaggtcgggacgtacggcctcaacaccttcaccaacatggaggcgcagctgatccgccagatggagggggagggcatcttcaagtccatccagcggctgaccgtgacggaggagatcgccgtgcagaactggctcgcccgcgtcggccgggagcgcctgagccggatggccatctccggggacgactgcgtggtgaagccgctggacgaccgcttcgccagcgcgctcaccgccctgaacgacatgggcaaggtccggaaggacatccagcagtgggagccctcccgcgggtggaacgactggacccaggtgcccttctgcagccaccacttccacgagctggtgatgaaggacggccgggtcctcgtggtgccctgccgcaaccaggacgagctgatcgggcgggcccgcatctcccagggcgccggctggagcctgaaggagaccgcctgcctcgggaagtcctacgcgcagatgtggacgctgatgtacttccaccggcgcgacctgcggctcgccgccaacgccatctgcagcgccgtcccgtcccactgggtgcccaccagccgcaccacctggtccatccacgcgaagcacgagtggatgaccacggaggacatgctggccgtgtggaaccgcgtctggatccaggagaacccctggatggaggacaagacccccgtggagagctgggaggaggtgccgtacctgggcaagcgggaggaccagtggtgcgggtccctcatcggcctgaccagccgcgccacctgggccaagaacatccagacggcgatcaaccaggtccggagcctgatcgggaacgaggagtacaccgactacatgccctccatgaagcgcttccggaaggaggaggaggaggccggcgtgctctggtga

SEQ ID NO: 9371 - RNA, 9876 nt, synthetic construct
  misc_feature 1..9876: note = derived and/or modified CDS sequence (opt1) from DENV-2__EU529700__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacctggagaagtaccagctggccgtcaccatcatggccatcagctgcgtgccgaacgccgtgatcctccagaacgcctggaaggtctcctgcaccatcctggcggccgtgagcgtcagccccctgctcctgacgagctcccagcagaaggccgactggatccccctggccctcaccatcaagggcctgaaccccaccgcgatcttcctgaccacgctcagccggacctccaagaagcgcagctggccgctgaacgaggccgtgatggccgtgggcatggtctccatcctggccagcagcctcctgaagaacgacatccccatgaccgggcccctggtggccggcgggctcctgaccgtgtgctacgtcctgacgggccggtccgcggacctcgagctggagcgcgccgccgacgtgaagtgggaggaccaggccgagatcagcgggtccagccccatcctgtccatcaccatcagcgaggacggctccatgagcatcaagaacgaggaggaggagcagaccctcaccatcctgatccggacgggcctgctcgtgatctccggggtcttcccggtgagcatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctacagccagatcggcgcgggggtctacaaggagggcaccttccacaccatgtggcacgtgacccgcggggccgtgctgatgcaccgcggcaagcggatcgagccctcctgggccgacgtcaagaaggacctgatcagctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgcggtgtccctggacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtcgtggccgcggagatggaggaggccctgcgggggctccccatccgctaccagacccccgccatccgggccgagcacacgggccgcgagatcgtggacctgatgtgccacgccaccttcaccatgcggctgctctcccccgtccgcgtgccgaactacaacctgatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctctcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctgaccgacggcgaggagcgggtcatcctggcggggcccatgccggtgacccacagctccgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgggagaaggtggacgcgatcgacggggagtaccgcctccggggcgaggcccgcaagacgttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggaccaaggagggcgagcgcaagaagctgaagccgcggtggctcgacgcccgcatctactccgaccccctggccctgaaggagttcaaggagttcgccgcgggccggaagtccctcaccctgaacctgatcaccgagatggggcgcctccccacgttcatgacccagaaggcccgggacgccctggacaacctggccgtcctccacaccgccgaggtgggcgggcgcgcgtacaaccacgccctgtccgagctgcccgagaccctcgagacgctgctgctcctgaccctgctcgccaccgtgaccggcggcatcttcctgttcctgatgagcgggaagggcatcgggaagatgacgctcggcatgtgctgcatcatcaccgcctccatcctgctgtggtacgcccagatccagccgcactggatcgcggccagcatcatcctcgagttcttcctgatcgtcctgctcatccccgagcccgagaagcagcggacgccccaggacaaccagctgacctacgtggtgatcgccatcctgaccgtcgtggccgccacgatggcgaacgagatggggttcctcgagaagaccaagaaggacctgggcctgggcagcatcaccacccaggagtccgagagcaacatcctcgacatcgacctgcgcccggcctccgcctggacgctgtacgccgtggccaccaccttcgtcacccccatgctccggcacagcatcgagaactccagcgtgaacgtgtccctgacggcgatcgccaaccaggccaccgtcctgatggggctcggccgcgggtggcccctgagcaagatggacatcggcgtgcccctgctcgccatcgggtgctactcccaggtgaacccgatcaccctgaccgcggccctgctcctgctggtcgcccactacgccatcatcggccccggcctccaggccaaggcgacgcgcgaggcccagaagcgggccgccgccgggatcatgaagaaccccaccgtggacggcatcaccgtgatcgacctggagcccatcccgtacgaccccaagttcgagaagcagctggggcaggtcatgctcctggtgctgtgcgtgacccaggtcctcatgatgcgcacgacctgggcgctgtgcgaggccctgaccctcgccaccggccccatcagcacgctgtgggaggggaaccccggccggttctggaacaccaccatcgccgtgtccatggccaacatcttccgcggcagctacctggcgggggccggcctcctgttctccatcatgaagaacaccacgaacacccggcgcgggaccggcaacatcggcgagaccctgggggagaagtggaagtcccggctcaacgccctgggcaagtccgagttccagatctacaagaagtccgggatccaggaggtggaccgcacgctggccaaggagggcatcaagcgcggggagaccgaccaccacgcggtctcccgcggcagcgccaagctccggtggttcgtggagcgcaacatggtgaccccggagggcaaggtcgtggacctggggtgcggccgcggcgggtggtcctactactgcggcgggctgaagaacgtgcgcgaggtcaaggggctcaccaagggcgggcccgggcacgaggagcccatccccatgagcacgtacggctggaacctggtgcggctgcagagcggggtggacgtcttcttcaccccgcccgagaagtgcgacaccctcctgtgcgacatcggcgagtccagccccaaccccaccatcgaggccggccgcacgctgcgggtgctcaacctggtggagaactggctgaacaacaacacccagttctgcatcaaggtcctcaacccgtacatgccctccgtgatcgagaagatggagaccctgcagcgcaagtacgggggcgccctggtgcggaaccccctgagccgcaactccacccacgagatgtactgggtcagcaacgccaccgggaacatcgtgtccagcgtgaacatgatctcccgcatgctcatcaaccggttcacgatgaagcacaagaaggcgacctacgagccggacgtcgacctgggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtggtccgcctcctgaccaagccctgggacgtggtgccgatggtcacgcagatggccatgaccgacaccacccccttcggccagcagcgggtgttcaaggagaaggtggacacgcgcacccaggagcccaaggagggcaccaagaagctgatgcggatcaccgccgagtggctctggaaggagctggggaagaagaagacgccccgcatgtgcacccgggaggagttcacccgcaaggtccggagcaacgcggccctgggcgccatcttcaccgacgagaacaagtggaagtccgcccgcgaggccgtggaggacagccggttctgggagctcgtcgaccgcgagcggaacctgcacctggaggggaagtgcgagacgtgcgtgtacaacatgatgggcaagcgcgagaagaagctcggggagttcggcaaggcgaagggctcccgggccatctggtacatgtggctgggggcccgcttcctggagttcgaggccctcggcttcctgaacgaggaccactggttcagccgggggaacagcctgtccggcgtggagggggagggcctccacaagctgggctacatcctgcgcgacgtcagcaagaaggagggcggcgcgatgtacgccgacgacaccgccgggtgggacacccggatcaccctcgaggacctgaagaacgaggagatggtgacgaaccacatgaagggcgagcacaagaagctggccgaggccatcttcaagctcacctaccagaacaaggtggtccgcgtgcagcgcccgacgccccgggggaccgtgatggacatcatctcccgcaaggaccagcggggcagcggccaggtcgggacgtacggcctgaacaccttcaccaacatggaggcgcagctgatccgccagatggagggggagggcatcttcaagtccatccagcacctcaccgtgacggaggagatcgccgtgcagaactggctggcccgggtcggccgcgagcggctgagccgcatggccatctccggggacgactgcgtggtgaagcccctcgacgaccggttcgccagcgcgctgaccgccctgaacgacatgggcaaggtccgcaaggacatccagcagtgggagccctcccgggggtggaacgactggacccaggtgccgttctgcagccaccacttccacgagctcgtgatgaaggacggccgcgtcctggtggtgccctgccggaaccaggacgagctgatcgggcgcgcccggatctcccagggcgccggctggagcctcaaggagaccgcctgcctggggaagtcctacgcgcagatgtggacgctgatgtacttccaccgccgggacctccgcctggccgccaacgccatctgcagcgccgtcccctcccactgggtgcccaccagccggaccacctggtccatccacgcgaagcacgagtggatgaccacggaggacatgctggccgtgtggaaccgcgtctggatccaggagaacccgtggatggaggacaagacccccgtggagagctgggaggaggtgccctacctcggcaagcgcgaggaccagtggtgcgggagcctgatcggcctgacctcccgggccacctgggccaagaacatccagacggcgatcaaccaggtccgcagcctcatcgggaacgaggagtacaccgactacatgccctccatgaagcggttccgcaaggaggaggaggaggccggcgtgctgtggtga

SEQ ID NO: 9372 - RNA, 9876 nt, synthetic construct
  misc_feature 1..9876: note = derived and/or modified CDS sequence (opt1) from DENV-2__EU529701__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccgtcgggaaggccctgcaccaggtgttcggcgcgatctacggcgccgccttcagcggggtgtcctggaccatgaagatcttcatcggcgtcatcatcacgtggatcgggatgaacagccgctccaccagcctgtccgtgagcctggtgctcgtcggcgtggtgaccctgtacctgggggccatggtccaggcggactccggctgcgtggtgagctggaagaacaaggagctcaagtgcggctccgggatcttcatcaccgacaacgtccacacgtggaccgagcagtacaagttccagcccgagagccccagcaagctggcctccgccatccagaaggcccacgaggagggcatctgcgggatccggagcgtgacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtcgaggactacggcttcggggtgttcacgaccaacatctggctcaagctgcgcgagaagcaggacgtgttctgcgactccaagctgatgagcgccgccatcaaggacaaccgggcggtccacgccgacatgggctactggatcgagtccgccctcaacgacacctggaagatggagaaggccagcttcatcgaggtgaagtcctgccactggcccaagagccacaccctgtggtccaacggcgtgctggagagcgagatgatcatccccaagaacttcgccgggcccgtctcccagcacaactaccgcccgggctaccacacccagacggcggggccctggcacctcggcaagctggagatggacttcgacttctgcgaggggaccaccgtggtggtcaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtgaacagcctggtgaccgccgggcacggccagatcgacaacttctccctcggcgtcctggggatggccctgttcctcgaggagatgctgcggacccgcgtgggcaccaagcacgcgatcctgctcgtggccgtcagcttcgtgacgctgatcaccgggaacatgtccttccgggacctgggccgcgtgatggtcatggtgggggccaccatgaccgacgacatcggcatgggcgtgacgtacctcgccctgctggccgcgttcaaggtccgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtgctgaagatcgtgcgcaacatggagaagtaccagctcgccgtcaccatcatggccatctcctgcgtgccgaacgccgtgatcctgcagaacgcgtggaaggtcagctgcacgatcctggccgccgtgtccgtcagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtgggcatggtgagcatcctcgcctccagcctgctgaagaacgacatccccatgaccgggcccctcgtcgcgggcgggctgctgacggtgtgctacgtgctcaccggccggagcgccgacctggagctggagcgcgccgccgacgtcaagtgggaggaccaggccgagatctccgggagctcccccatcctcagcatcaccatctccgaggacggcagcatgtccatcaagaacgaggaggaggagcagaccctgacgatcctgatccggaccggcctcctggtgatcagcggggtgttcccggtctccatccccatcaccgcggccgcctggtacctgtgggaggtgaagaagcagcgcgccggcgtgctctgggacgtccccagcccgccgcccgtggggaaggccgagctggaggacggcgcgtaccggatcaagcagcgcgggatcctgggctactcccagatcggcgccggggtgtacaaggagggcaccttccacaccatgtggcacgtcacgcgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgcggtgcagaccaagcccggcctgttcaagaccaacaccgggacgatcggcgccgtcagcctcgacttctcccccggcaccagcgggtcccccatcgtggaccggaagggcaaggtggtcgggctgtacggcaacggcgtggtgacccgcagcggggcctacgtctccgccatcgcgcagaccgagaagtccatcgaggacaaccccgagatcgaggacgacatcttccggaagaagcgcctgacgatcatggacctccaccccggcgccgggaagaccaagcggtacctgcccgccatcgtgcgcgaggccatcaagcggggcctgcgcaccctgatcctcgccccgacccgcgtggtcgcggccgagatggaggaggccctgcgggggctgcccatccgctaccagacgcccgccatccgggccgagcacaccggccgcgagatcgtggacctcatgtgccacgcgaccttcaccatgcggctgctgagccccgtgcgcgtcccgaactacaacctcatcatcatggacgaggcccacttcacggaccccgcctccatcgccgcccggggctacatcagcacccgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggcgggcaacgacatcgccgcctgcctgcgcaagaacggcaagaaggtgatccagctgagccggaagaccttcgactccgagtacgtcaagacccgcgccaacgactgggacttcgtggtgacgaccgacatcagcgagatgggggccaacttcaaggcggagcgggtcatcgacccccgccggtgcatgaagcccgtgatcctcaccgacggcgaggagcgcgtgatcctggccgggcccatgccggtcacccactccagcgccgcccagcggcgcggccgcatcgggcggaaccccaagaacgagaacgaccagtacatctacatgggcgagcccctggagaacgacgaggactgcgcccactggaaggaggcgaagatgctcctggacaacatcaacacgcccgagggcatcatcccgtccatgttcgagcccgagcgcgagaaggtggacgccatcgacggggagtaccggctgcgcggcgaggcccggaagaccttcgtggacctcatgcgccgcggggacctgcccgtctggctggcctaccgcgtggccgcggagggcatcaactacgccgaccggcgctggtgcttcgacgggatcaagaacaaccagatcctcgaggagaacgtggaggtcgagatctggaccaaggagggcgagcggaagaagctgaagccgcgctggctggacgcccggatctacagcgaccccctcgccctgaaggagttcaaggagttcgcggccggccgcaagtccctgaccctcaacctgatcacggagatggggcggctgcccaccttcatgacccagaaggcccgcgacgccctcgacaacctggccgtgctgcacaccgcggaggccggcgggaaggcctacaaccacgccctcagcgagctgcccgagacgctggagaccctcctgctgctcaccctgctggccaccgtcacgggcggcatcttcctcttcctgatgtccgggaagggcatcgggaagatgaccctgggcatgtgctgcatcatcaccgcgagcatcctcctgtggtacgcccagatccagccgcactggatcgccgcctccatcatcctggagttcttcctcatcgtgctgctgatccccgagcccgagaagcagcggacgccccaggacaaccagctcacctacgtggtcatcgccatcctgacggtggtggcggccaccatggccaacgagatggggttcctggagaagaccaagaaggacctcggcctgggcagcatcaccacgcaggagagcgagtccaacatcctggacatcgacctccgcccggccagcgcctggaccctgtacgcggtcgccaccaccttcgtgacgcccatgctgcggcactccatcgagaacagctccgtgaacgtcagcctcaccgccatcgccaaccaggcgaccgtgctgatggggctgggcaaggggtggcccctctccaagatggacatcggcgtgcccctgctggccatcgggtgctacagccaggtcaacccgatcaccctcacggccgccctgctgctcctggtggcccactacgcgatcatcggccccggcctgcaggccaaggccacccgcgaggcccagaagcgggccgcggccgggatcatgaagaaccccaccgtggacggcatcaccgtcatcgacctcgagcccatcccgtacgaccccaagttcgagaagcagctgggccaggtgatgctgctcatcctgtgcgtgacgcaggtcctgatgatgcgcaccacctgggccctctgcgaggccctgaccctggccacgggccccatctccaccctctgggaggggaaccccggccgcttctggaacaccaccatcgcggtgagcatggccaacatcttccggggctcctacctggccggggccggcctcctgttcagcatcatgaagaacacgaccaacacccgccgggggaccggcaacatcggcgagacgctgggggagaagtggaagtcccgcctgaacgcgctcggcaagagcgagttccagatctacaagaagtccgggatccaggaggtggaccggaccctggccaaggagggcatcaagcgcggggagaccgaccaccacgccgtcagccggggctccgccaagctgcgctggttcgtggagcggaacatggtgaccccggagggcaaggtcgtggacctcgggtgcggccgcgggggctggagctactactgcgggggcctgaagaacgtgcgggaggtcaagggcctgacgaagggcgggcccgggcacgaggagcccatccccatgtccacctacggctggaacctcgtgcgcctgcagagcggggtggacgtcttcttcaccccgcccgagaagtgcgacaccctgctctgcgacatcggcgagagctcccccaaccccacgatcgaggccggccggaccctgcgcgtgctgaacctcgtggagaactggctgaacaacaacacccagttctgcatcaaggtcctgaacccgtacatgcccagcgtgatcgagaagatggagaccctccagcggaagtacgggggcgcgctggtgcgcaaccccctgtcccggaacagcacccacgagatgtactgggtctccaacgccacggggaacatcgtgagctccgtgaacatgatcagccgcatgctgatcaaccggttcaccatgaagcacaagaaggccacctacgagccggacgtcgacctcggctccgggacccgcaacatcggcatcgagagcgagatccccaacctggacatcatcggcaagcgcatcgagaagatcaagcaggagcacgagacgtcctggcactacgaccaggaccacccctacaagacctgggcctaccacgggagctacgagaccaagcagaccggctccgccagctccatggtgaacggggtggtccggctgctcacgaagccctgggacgtggtgccgatggtcacccagatggcgatgaccgacaccacgcccttcggccagcagcgcgtgttcaaggagaaggtggacacccggacccaggagcccaaggagggcaccaagaagctgatgaagatcacggccgagtggctgtggaaggagctcgggaagaagaagacgccccggatgtgcacccgggaggagttcacccgcaaggtccggagcaacgccgccctgggcgccatcttcacggacgagaacaagtggaagtccgcgcgcgaggccgtggaggacagccggttctgggagctggtggaccgcgagcggaacctccacctggaggggaagtgcgagacctgcgtctacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtggagggggagggcctgcaccgcctcggctacatcctgcgggacgtcagcaagaaggagggcggggccatgtacgccgacgacaccgccgggtgggacacccgcatcacgctggaggacctcaagaacgaggagatggtgaccaaccacatgaagggcgagcacaagaagctggcggaggccatcttcaagctgacctaccagaacaaggtggtccgggtgcagcgcccgacgccccgggggacggtgatggacatcatctcccgccgcgaccagcggggcagcggccaggtcgggacctacggcctcaacaccttcaccaacatggaggcccagctgatccgccagatggagggggagggcatcttcaagtccatccagcacctgacggtgaccgaggagatcgccgtgcagaactggctcgcccgggtcggccgcgagcggctgagccgcatggcgatctccggggacgactgcgtggtgaagcccctggacgaccggttcgccagcgccctcaccgccctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgcgggctggagcctgaaggagacggcctgcctcgggaagtcctacgcccagatgtggaccctgatgtacttccaccgccgggacctgcgcctcgccgccaacgcgatctgcagcgccgtcccctcccactgggtgcccaccagccggaccacctggtccatccacgccaagcacgagtggatgacgaccgaggacatgctggccgtgtggaaccgcgtctggatccaggagaacccgtggatggaggacaagacccccgtggagagctgggaggaggtgccctacctgggcaagcgggaggaccagtggtgcgggagcctcatcggcctgacctcccgcgcgacgtgggccaagaacatccagaccgccatcaaccaggtccgcagcctgatcgggaacgaggagtacaccgactacatgccctccatgaagcggttccgccgggaggaggaggaggccggcgtgctctggtga

SEQ ID NO: 9373 - RNA, 9876 nt, synthetic construct
  misc_feature 1..9876: note = derived and/or modified CDS sequence (opt1) from DENV-2__EU569704__SS-prME
  source 1..9876: mol_type = other RNA
accgccggcgtgatcatcatgctgatccccaccgccatggcgttccacctcaccacccggaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgctgcccgagaacctcgagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctggacttcaacgagatggtgctcctgcagatggaggacaaggcctggctggtccaccggcagtggttcctcgacctgcccctgccctggctcccgggggccgacacccagggcagcaactggatccagaaggagacgctggtgaccttcaagaacccccacgcgaagaagcaggacgtggtcgtgctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctggggcgcctcatcaccgtgaacccgatcgtgaccgagaaggacagccccgtcaacatcgaggcggagccgcccttcggcgactcctacatcatcatcggggtggagccgggccagctgaagctgaactggttcaagaaggggagctccatcggccagatgttcgagaccacgatgcgcggcgccaagcggatggccatcctcggggacaccgcctgggacttcggcagcctcggcggggtgttcacctccatcgggaaggccctgcaccaggtcttcggggcgatctacggcgccgccttcagcggggtgtcctggaccatgaagatcctgatcggcgtgatcatcacgtggatcgggatgaacagccgctccaccagcctctccgtcagcctggtgctggtgggcgtcgtgaccctctacctgggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctcgcctccgccatccagaaggcccacgaggagggcatctgcgggatccggagcgtcacccgcctggagaacctgatgtggaagcagatcacccccgagctcaaccacatcctgtccgagaacgaggtgaagctgacgatcatgaccggcgacatcaaggggatcatgcaggccggcaagcggagcctccgcccgcagcccaccgagctgaagtactcctggaagacctggggcaaggcgaagatgctgagcacggagtcccacaaccagaccttcctcatcgacgggcccgagaccgccgagtgcccgaacaccaaccgggcctggaacagcctggaggtggaggactacggcttcggggtcttcacgaccaacatctggctgaagctccgcgagaagcaggacgtgttctgcgactccaagctgatgagcgccgccatcaaggacaaccgggcggtgcacgccgacatgggctactggatcgagtccgccctgaacgacacctggaagatggagaaggccagcttcatcgaggtcaagtcctgccactggcccaagagccacaccctctggtccaacggcgtgctggagagcgagatgatcatccccaagaacttcgccgggcccgtgtcccagcacaactaccgcccgggctaccacacccagacggcggggccctggcacctgggcaagctcgagatggacttcgacttctgcgaggggaccaccgtcgtggtgaccgaggactgcggcaaccggggccccagcctgcgcacgaccaccgccagcgggaagctgatcaccgagtggtgctgccggtcctgcacgctgccgcccctgcgctaccggggcgaggacgggtgctggtacggcatggagatccgccccctgaaggagaaggaggagaacctcgtcaacagcctggtgaccgccgggcacggccagatcgacaacttctccctgggcatcctcgggatggccctgttcctggaggagatgctccggacccgcgtgggcaccaagcacgcgatcctgctggtcgccgtgagcttcgtgacgctcatcaccgggaacatgtccttccgggacctgggccgcgtcatggtgatggtgggggccaccatgaccgacgacatcggcatgggcgtcacgtacctggccctcctggccgcgttcaaggtgcgccccaccttcgccgccgggctgctcctgcggaagctgaccagcaaggagctcatgatggccaccatcggcatcgccctgctgtcccagagcacgatccccgagaccatcctcgagctgaccgacgcgctggccctcgggatgatggtgctgaagatcgtccgcaacatggagaagtaccagctggccgtgaccatcatggccatctcctgcgtgcccaacgccgtcatcctccagaacgcgtggaaggtgagctgcacgatcctggccgccgtgtccgtcagccccctgctcctgacctccagccagcagaaggccgactggatccccctggcgctcaccatcaagggcctgaaccccaccgccatcttcctgacgaccctctcccggaccagcaagaagcgctcctggccgctgaacgaggccatcatggccgtgggcatggtcagcatcctggcctccagcctcctgaagaacgacatccccatgaccgggcccctggtggcgggcgggctcctgacggtgtgctacgtcctgaccggccggagcgccgacctcgagctggagcgcgccgccgacgtgaagtgggaggaccaggccgagatctccgggagctcccccatcctgagcatcaccatctccgaggacggcagcatgtccatcaagaacgaggaggaggagcagaccctcacgatcctgatccggaccggcctgctcgtgatcagcggggtcttcccggtgtccatccccatcaccgcggccgcctggtacctgtgggaggtgaagaagcagcgcgccggcgtcctgtgggacgtgccctccccgccgcccgtggggaaggccgagctcgaggacggcgcgtaccggatcaagcagcgcgggatcctgggctactcccagatcggcgccggggtctacaaggagggcaccttccacaccatgtggcacgtgacgcgcggggccgtgctgatgcaccgcggcaagcggatcgagcccagctgggccgacgtcaagaaggacctcatctcctacgggggcggctggaagctggagggggagtggaaggagggcgaggaggtccaggtgctggccctcgagcccgggaagaacccccgcgcggtccagaccaagcccggcctgttcaagaccaacaccgggacgatcggcgccgtgagcctggacttctcccccggcaccagcgggtcccccatcgtggaccggaagggcaaggtcgtggggctctacggcaacggcgtggtcacccgcagcggggcctacgtgtccgccatcgcgcagaccgagaagtccatcgaggacaaccccgagatcgaggacgacatcttccggaagaagcgcctgacgatcatggacctgcaccccggcgccgggaagaccaagcggtacctgcccgccatcgtgcgcgaggccatcaagcggggcctccgcaccctgatcctggccccgacccgcgtcgtggcggccgagatggaggaggccctccgggggctgcccatccgctaccagacgcccgccatccgggccgagcacaccggccgcgagatcgtggacctgatgtgccacgcgaccttcaccatgcggctcctgagccccgtccgcgtgccgaactacaacctgatcatcatggacgaggcccacttcacggaccccgcctccatcgccgcccggggctacatcagcacccgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtcacggacttcaaggggaagaccgtgtggttcgtgccgtccatcaaggcgggcaacgacatcgccgcctgcctccgcaagaacggcaagaaggtcatccagctgagccggaagaccttcgactccgagtacgtgaagacccgcgccaacgactgggacttcgtggtcacgaccgacatcagcgagatgggggccaacttcaaggcggagcgggtgatcgacccccgccggtgcatgaagcccgtgatcctgaccgacggcgaggagcgcgtcatcctcgccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacgcccgagggcatcatcccgtccatgttcgagcccgagcgcgagaaggtggacgccatcgacggggagtaccggctgcgcggcgaggcccggaagaccttcgtcgacctgatgcgccgcggggacctccccgtgtggctggcctaccgcgtggccgcggagggcatcaactacgccgaccggcgctggtgcttcgacgggatcaagaacaaccagatcctggaggagaacgtcgaggtggagatctggaccaaggagggcgagcggaagaagctcaagccgcgctggctggacgcccggatctacagcgaccccctggccctcaaggagttcaaggagttcgcggccggccgcaagtccctgaccctgaacctcatcacggagatggggcggctgcccaccttcatgacccagaaggcccgcgacgccctggacaacctcgccgtgctgcacaccgcggaggccggcgggcgggcctacaaccacgccctgagcgagctccccgagacgctggagaccctgctcctgctgaccctcctggccaccgtcacgggcggcatcttcctgttcctcatgtccgggaagggcatcgggaagatgaccctgggcatgtgctgcatcatcaccgcgagcatcctgctctggtacgcccagatccagccgcactggatcgccgcctccatcatcctggagttcttcctgatcgtgctcctgatccccgagcccgagaagcagcgcacgccccaggacaaccagctgacctacgtcgtgatcgccatcctcacggtggtcgcggccaccatggccaacgagatggggttcctggagaagaccaagaaggacctgggcctcggcagcatcaccacgcaggagagcgagtccaacatcctggacatcgacctgcggccggccagcgcctggaccctctacgcggtggccaccaccttcgtgacgcccatgctgcgccactccatcgagaacagctccgtcaacgtgagcctgaccgccatcgccaaccaggcgaccgtgctcatggggctgggcaaggggtggcccctgtccaagatggacatcggcgtccccctcctggccatcgggtgctacagccaggtgaacccgatcaccctgacggccgccctcctgctgctcgtggcccactacgcgatcatcggccccggcctgcaggccaaggccacccgggaggcccagaagcgcgccgcggccgggatcatgaagaaccccaccgtcgacggcatcaccgtgatcgacctggagcccatcccgtacgaccccaagttcgagaagcagctcggccaggtgatgctgctgatcctctgcgtcacccaggtgctgatgatgcgcaccacctgggccctgtgcgaggccctcaccctggccacgggccccatctccaccctgtgggaggggaaccccggccggttctggaacaccaccatcgcggtgagcatggccaacatcttccgcggctcctacctcgccggggccggcctgctgttcagcatcatgaagaacacgaccaacacccggcgcgggaccggcaacatcggcgagacgctcggggagaagtggaagtcccggctgaacgcgctgggcaagagcgagttccagatctacaagaagtccgggatccaggaggtcgaccgcaccctcgccaaggagggcatcaagcgcggggagaccgaccaccacgccgtgagccgcggctccgccaagctgcggtggttcgtggagcgcaacatggtcaccccggagggcaaggtggtggacctggggtgcggccgcggcgggtggagctactactgcggcgggctcaagaacgtccgcgaggtgaaggggctgacgaagggcggccccgggcacgaggagcccatccccatgtccacctacggctggaacctggtgcggctccagagcggggtcgacgtgttcttcaccccgcccgagaagtgcgacaccctgctgtgcgacatcggcgagagctcccccaaccccacgatcgaggccggccgcaccctccgggtgctgaacctggtcgagaactggctcaacaacaacacccagttctgcatcaaggtgctgaacccgtacatgcccagcgtgatcgagaagatggagaccctgcagcgcaagtacgggggcgcgctggtccggaaccccctctcccgcaacagcacccacgagatgtactgggtgtccaacgccacggggaacatcgtgagctccgtcaacatgatcagccggatgctgatcaaccgcttcaccatgaagcacaagaaggccacctacgagccggacgtggacctgggctccgggacccgcaacatcggcatcgagagcgagatccccaacctcgacatcatcggcaagcggatcgagaagatcaagcaggagcacgagacgtcctggcactacgaccaggaccacccctacaagacctgggcctaccacgggagctacgagaccaagcagaccggctccgccagctccatggtgaacggggtcgtgcgcctgctgacgaagccctgggacgtggtcccgatggtgacccagatggcgatgaccgacaccacgcccttcggccagcagcgggtgttcaaggagaaggtcgacacccgcacccaggagcccaaggagggcaccaagaagctcatgaagatcacggccgagtggctgtggaaggagctggggaagaagaagacgccccggatgtgcacccgcgaggagttcacccggaaggtgcgcagcaacgccgccctcggcgccatcttcacggacgagaacaagtggaagtccgcgcgggaggccgtggaggacagccgcttctgggagctgatcgaccgggagcgcaacctgcacctcgaggggaagtgcgagacctgcgtctacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtggagggggagggcctgcaccggctgggctacatcctccgcgacgtgagcaagaaggagggcggcgccatgtacgccgacgacaccgccgggtgggacacccggatcacgctggaggacctgaagaacgaggagatggtcaccaaccacatgaagggcgagcacaagaagctcgcggaggccatcttcaagctgacctaccagaacaaggtggtccgcgtgcagcggccgacgccccgcgggaccgtgatggacatcatctcccgccgggaccagcgcggcagcggccaggtcgggacctacggcctgaacaccttcaccaacatggaggcccagctcatccggcagatggagggggagggcatcttcaagtccatccagcacctgacggtgaccgaggagatcgccgtgcagaactggctggcccgcgtcggccgggagcgcctcagccggatggcgatctccggggacgactgcgtggtgaagcccctggacgaccgcttcgccagcgccctgaccgccctcaacgacatgggcaaggtccggaaggacatccagcagtgggagccctcccgcgggtggaacgactggacccaggtgccgttctgcagccaccacttccacgagctggtgatgaaggacggccgggtcctggtggtgccctgccgcaaccaggacgagctcatcgggcgggcccgcatctcccagggcgcgggctggagcctgaaggagacggcctgcctggggaagtcctacgcccagatgtggaccctcatgtacttccaccggcgcgacctgcggctggccgccaacgcgatctgcagcgccgtcccctcccactgggtgcccaccagccgcaccacctggtccatccacgccaagcacgagtggatgacgaccgaggacatgctcgccgtgtggaaccgggtctggatccaggagaacccgtggatggaggacaagacccccgtggagagctgggaggaggtgccctacctgggcaagcgcgaggaccagtggtgcgggagcctgatcggcctcacctcccgcgcgacgtgggccaagaacatccagaccgccatcaaccaggtccggagcctgatcgggaacgaggagtacaccgactacatgccctccatgaagcgcttccggcgcgaggaggaggaggccggcgtgctgtggtga

SEQ ID NO: 9374 - RNA, 9876 nt, synthetic construct
  misc_feature 1..9876: note = derived and/or modified CDS sequence (opt1) from DENV-2__EU482568__SS-prME
  source 1..9876: mol_type = other RNA
accgccggcgtgatcatcatgctgatccccaccgccatggcgttccacctcaccacccgcaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacgtacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgctgcccgagaacctcgagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctggacttcaacgagatggtgctcctgcagatggaggacaaggcctggctggtccaccggcagtggttcctcgacctgcccctgccctggctcccgggggccgacacccagggcagcaactggatccagaaggagacgctggtgaccttcaagaacccccacgcgaagaagcaggacgtggtcgtgctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctggggcgcctcatcaccgtgaacccgatcgtgaccgagaaggacagccccgtcaacatcgaggcggagccgcccttcggcgactcctacatcatcatcggggtggagccgggccagctgaagctgaactggttcaagaaggggagctccatcggccagatgttcgagaccacgatgcgcggcgccaagcggatggccatcctcggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctctccgtcagcctggtgctggtgggcgtcgtgaccctctacctgggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctcgcctccgccatccagaaggcccacgaggagggcatctgcgggatccggagcgtcacccgcctggagaacctgatgtggaagcagatcacccccgagctcaaccacatcctgtccgagaacgaggtgaagctgacgatcatgaccggcgacatccgggggatcatgcaggccggcaagcgcagcctccggccgcagcccaccgagctgaagtactcctggaagacctggggcaaggcgaagatgctgagcacggagtcccacaaccagaccttcctcatcgacgggcccgagaccgccgagtgcccgaacaccaaccgcgcctggaacagcctggaggtggaggactacggcttcggggtcttcacgaccaacatctggctgaagctccgggagaagcaggacgtgttctgcgactccaagctgatgagcgccgccatcaaggacaaccgcgcggtgcacgccgacatgggctactggatcgagtccgccctgaacgacacctggaagatggagaaggccagcttcatcgaggtcaagtcctgccactggcccaagagccacaccctctggtccaacggcgtgctggagagcgagatgatcatccccaagaacttcgccgggcccgtgtcccagcacaactaccggccgggctaccacacccagacggcggggccctggcacctgggcaagctcgagatggacttcgacttctgcgaggggaccaccgtcgtggtgaccgaggactgcggcaaccgcggccccagcctgcggacgaccaccgccagcgggaagctgatcaccgagtggtgctgccgctcctgcacgctgccgcccctgcggtaccgcggcgaggacgggtgctggtacggcatggagatccggcccctgaaggagaaggaggagaacctcgtcaacagcctggtgaccgccgggcacggccagatcgacaacttctccctgggcatcctcgggatggccctgttcctggaggagatgctccgcacccgggtgggcaccaagcacgcgatcctgctggtcgccgtgagcttcgtgacgctcatcaccgggaacatgtccttccgcgacctgggccgcgtcatggtgatggtgggggccaccatgaccgacgacatcggcatgggcgtcacgtacctggccctcctggccgcgttcaaggtgcggcccaccttcgccgccgggctgctcctgcgcaagctgaccagcaaggagctcatgatggccaccatcggcatcgccctgctgtcccagagcacgatccccgagaccatcctcgagctgaccgacgcgctggccctcgggatgatggtgctgaagatcgtccggaacatggagaagtaccagctggccgtgaccatcatggccatctcctgcgtgcccaacgccgtcatcctccagaacgcgtggaaggtgagctgcacgatcctggccgccgtgtccgtcagccccctgctcctgacctccagccagcagaaggccgactggatccccctggcgctcaccatcaagggcctgaaccccaccgccatcttcctgacgaccctctcccgcaccagcaagaagcggtcctggccgctgaacgaggccatcatggccgtgggcatggtcagcatcctggcctccagcctcctgaagaacgacatccccatgaccgggcccctggtggcgggcgggctcctgacggtgtgctacgtcctgaccggccgcagcgccgacctcgagctggagcgggccgccgacgtgaagtgggaggaccaggccgagatctccgggagctcccccatcctgagcatcaccatctccgaggacggcagcatgtccatcaagaacgaggaggaggagcagaccctcacgatcctgatccgcaccggcctgctcgtgatcagcggggtcttcccggtgtccatccccatcaccgcggccgcctggtacctgtgggaggtgaagaagcagcgggccggcgtcctgtgggacgtgccctccccgccgcccgtggagaaggccgagctcgaggacggggcgtaccgcatcaagcagcggggcatcctggggtactcccagatcggcgccggcgtctacaaggaggggaccttccacaccatgtggcacgtgacgcgcggcgccgtgctgatgcaccgggggaagcgcgtcgagcccagctgggccgacgtgaagaaggacctcatctcctacggcgggggctggaagctggagggcgagtggaaggagggggaggaggtgcaggtcctggccctcgagcccggcaagaacccccgggcggtgcagaccaagcccgggctgttcaagaccaacaccggcacgatcggggccgtgagcctggacttctcccccggcaccagcggctcccccatcgtcgaccgcaaggggaaggtggtgggcctctacgggaacggcgtcgtgacccggagcggcgcctacgtgtccgccatcgcgcagaccgagaagtccatcgaggacaaccccgagatcgaggacgacatcttccgcaagaagcggctgacgatcatggacctgcaccccggggccggcaagaccaagcgctacctgcccgccatcgtccgggaggccatcaagcgcgggctccgcaccctgatcctggccccgacccgggtggtggcggccgagatggaggaggccctccgcggcctgcccatccggtaccagacgcccgccatccgcgccgagcacaccgggcgggagatcgtcgacctgatgtgccacgcgaccttcaccatgcgcctcctgagccccgtgcgggtgccgaactacaacctgatcatcatggacgaggcccacttcacggaccccgcctccatcgccgcccgcggctacatcagcacccgggtcgagatgggcgaggcggccgggatcttcatgaccgccacgccgcccggctcccgcgacccgttcccccagagcaacgcccccatcatggacgaggagcgggagatccccgagcgctcctggaacagcgggcacgagtgggtgacggacttcaagggcaagaccgtgtggttcgtcccgtccatcaaggcggggaacgacatcgccgcctgcctccggaagaacggcaagaaggtgatccagctgagccgcaagaccttcgactccgagtacgtgaagacccgggccaacgactgggacttcgtcgtgacgaccgacatcagcgagatgggcgccaacttcaaggcggagcgcgtgatcgacccccggcgctgcatgaagcccgtcatcctgaccgacggggaggagcgggtgatcctcgccggccccatgccggtgacccactccagcgccgcccagcgccgcgggcggatcggccgcaaccccaagaacgagaacgaccagtacatctacatgggggagcccctggagaacgacgaggactgcgcccactggaaggaggcgaagatgctgctcgacaacatcaacacgcccgagggcatcatcccgtccatgttcgagcccgagcgggagaaggtcgacgccatcgacggcgagtaccgcctgcgcggggaggcccgcaagaccttcgtggacctgatgcggcgcggcgacctccccgtgtggctggcctaccgggtcgccgcggaggggatcaactacgccgaccgccggtggtgcttcgacggcatcaagaacaaccagatcctggaggagaacgtggaggtggagatctggaccaaggagggggagcgcaagaagctcaagccgcggtggctggacgcccgcatctacagcgaccccctggccctcaaggagttcaaggagttcgcggccggccggaagtccctgaccctgaacctcatcacggagatgggccgcctgcccaccttcatgacccagaaggcccgggacgccctggacaacctcgccgtcctgcacaccgcggaggccgggggccgcgcctacaaccacgccctgagcgagctccccgagacgctggagaccctgctcctgctgaccctcctggccaccgtgaccgggggcatcttcctgttcctcatgtccggcaaggggatcggcaagatgaccctggggatgtgctgcatcatcaccgcgagcatcctgctctggtacgcccagatccagccgcactggatcgccgcctccatcatcctggagttcttcctgatcgtcctcctgatccccgagcccgagaagcagcggacgccccaggacaaccagctgacctacgtggtgatcgccatcctcacggtcgtggcggccaccatggccaacgagatgggcttcctggagaagaccaagaaggacctggggctcggcagcatcaccacgcaggagagcgagtccaacatcctggacatcgacctgcgcccggccagcgcctggaccctctacgcggtggccaccaccttcgtcacgcccatgctgcggcactccatcgagaacagctccgtgaacgtgagcctgaccgccatcgccaaccaggcgaccgtcctcatgggcctggggaagggctggcccctgtccaagatggacatcggggtgcccctcctggccatcggctgctacagccaggtgaacccgatcaccctgacggccgccctcctgctgctcgtcgcccactacgcgatcatcgggcccggcctgcaggccaaggccacccgcgaggcccagaagcgcgccgcggccggcatcatgaagaaccccaccgtggacgggatcaccgtgatcgacctggagcccatcccgtacgaccccaagttcgagaagcagctcggccaggtcatgctgctgatcctctgcgtgacccaggtgctgatgatgcggaccacctgggccctgtgcgaggccctcaccctggccacggggcccatctccaccctgtgggagggcaaccccgggcgcttctggaacaccaccatcgcggtcagcatggccaacatcttccggggctcctacctcgccggcgccgggctgctgttcagcatcatgaagaacacgaccaacacccgccggggcaccgggaacatcggcgagacgctcggcgagaagtggaagtcccgcctgaacgcgctgggcaagagcgagttccagatctacaagaagtccggcatccaggaggtggaccggaccctcgccaaggaggggatcaagcgcggcgagaccgaccaccacgccgtgagccgggggtccgccaagctgcgctggttcgtcgagcggaacatggtgaccccggagggcaaggtggtcgacctgggctgcgggcgcggcgggtggagctactactgcggcgggctcaagaacgtgcgggaggtgaagggcctgacgaagggcgggcccggccacgaggagcccatccccatgtccacctacgggtggaacctggtccgcctccagagcggcgtggacgtgttcttcaccccgcccgagaagtgcgacaccctgctgtgcgacatcggggagagctcccccaaccccacgatcgaggccggccggaccctccgcgtcctgaacctggtggagaactggctcaacaacaacacccagttctgcatcaaggtgctgaacccgtacatgcccagcgtcatcgagaagatggagaccctgcagcggaagtacggcggggcgctggtgcgcaaccccctctcccggaacagcacccacgagatgtactgggtgtccaacgccacgggcaacatcgtcagctccgtgaacatgatcagccgcatgctgatcaaccgcttcaccatgaagcacaagaaggccacctacgagccggacgtggacctggggtccggcacccggaacatcgggatcgagagcgagatccccaacctcgacatcatcggcaagcgcatcgagaagatcaagcaggagcacgagacgtcctggcactacgaccaggaccacccctacaagacctgggcctaccacggcagctacgagaccaagcagaccgggtccgccagctccatggtcaacggcgtggtgcggctgctgacgaagccctgggacgtcgtgccgatggtgacccagatggcgatgaccgacaccacgcccttcgggcagcagcgcgtcttcaaggagaaggtggacacccggacccaggagcccaaggagggcaccaagaagctcatgaagatcacggccgagtggctgtggaaggagctgggcaagaagaagacgccccgcatgtgcacccgggaggagttcacccgcaaggtgcggagcaacgccgccctcggggccatcttcacggacgagaacaagtggaagtccgcgcgcgaggccgtcgaggacagccggttctgggagctgatcgaccgcgagcggaacctgcacctcgagggcaagtgcgagacctgcgtgtacaacatgatggggaagcgcgagaagaagctgggcgagttcgggaaggccaagggctcccgggccatctggtacatgtggctgggcgcgcgcttcctcgagttcgaggccctggggttcctgaacgaggaccactggttcagccggggcaacagcctctccggggtggagggcgaggggctgcaccgcctgggctacatcctccgggacgtcagcaagaaggagggcggggccatgtacgccgacgacaccgccggctgggacacccgcatcacgctggaggacctgaagaacgaggagatggtgaccaaccacatgaagggggagcacaagaagctcgcggaggccatcttcaagctgacctaccagaacaaggtcgtgcgggtgcagcgcccgacgccccgcggcaccgtcatggacatcatctcccggcgcgaccagcgggggagcggccaggtgggcacctacgggctgaacaccttcaccaacatggaggcccagctcatccgccagatggagggcgaggggatcttcaagtccatccagcacctgacggtgaccgaggagatcgccgtccagaactggctggcccgggtgggccgcgagcggctcagccgcatggcgatctccggcgacgactgcgtggtcaagcccctggacgaccggttcgccagcgccctgaccgccctcaacgacatggggaaggtgcgcaaggacatccagcagtgggagccctcccggggctggaacgactggacccaggtgccgttctgcagccaccacttccacgagctggtcatgaaggacgggcgcgtgctggtggtcccctgccggaaccaggacgagctcatcggccgcgcccggatctcccagggggcgggctggagcctgaaggagacggcctgcctgggcaagtcctacgcccagatgtgggccctcatgtacttccaccgccgggacctgcgcctggccgcgaacgccatctgcagcgccgtgccctcccactgggtgcccaccagccggaccacctggtccatccacgccaagcacgagtggatgaccacggaggacatgctcgcggtctggaaccgcgtgtggatccaggagaacccgtggatggaggacaagacccccgtggagagctgggaggaggtcccctacctggggaagcgcgaggaccagtggtgcggcagcctgatcgggctcacctcccgggccacctgggccaagaacatccagacggccatcaaccaggtgcgcagcctgatcggcaacgaggagtacaccgactacatgccctccatgaagcggttccgccgggaggaggaggaggccggggtgctgtggtga

SEQ ID NO: 9375 - RNA, 9876 nt, synthetic construct
  misc_feature 1..9876: note = derived and/or modified CDS sequence (opt1) from DENV-2__EU482569__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagaacaaggagctgaagtgcggctccgggatcttcatcaccgacaacgtccacacgtggaccgagcagtacaagttccagcccgagagccccagcaagctggcctccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggcgaagatgctgagcacggagtcccacaaccagaccttcctgatcgacgggcccgagaccgccgagtgcccgaacaccaaccgggcctggaacagcctcgaggtcgaggactacggcttcggggtgttcacgaccaacatctggctgaagctgcgcgagaagcaggacgtgttctgcgactccaagctcatgagcgccgccatcaaggacaaccgggcggtccacgccgacatgggctactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgccgggcccgtctcccagcacaactaccgcccgggctaccacacccagacggcggggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcgtgggcaccaagcacgcgatcctcctggtggccgtcagcttcgtgacgctgatcaccgggaacatgtccttccgggacctcggccgcgtgatggtcatggtgggggccaccatgaccgacgacatcggcatgggcgtgacgtacctggccctgctcgccgcgttcaaggtccgccccaccttcgccgccgggctgctgctccggaagctgaccagcaaggagctgatgatggccaccatcggcatcgccctcctgtcccagagcacgatccccgagaccatcctggagctcaccgacgcgctggccctggggatgatggtgctcaagatcgtgcgcaacatggagaagtaccagctggccgtcaccatcatggccatctcctgcgtgccgaacgccgtgatcctgcagaacgcgtggaaggtcagctgcacgatcctcgccgccgtgtccgtcagccccctgctgctcacctccagccagcagaaggccgactggatccccctggcgctgaccatcaagggcctcaaccccaccgccatcttcctgacgaccctgtcccggaccagcaagaagcgctcctggccgctcaacgaggccatcatggccgtgggcatggtgagcatcctggcctccagcctgctcaagaacgacatccccatgaccgggcccctggtcgcgggcgggctgctcacggtgtgctacgtgctgaccggccggagcgccgacctggagctcgagcgcgccgccgacgtcaagtgggaggaccaggccgagatctccgggagctcccccatcctgagcatcaccatctccgaggacggcagcatgtccatcaagaacgaggaggaggagcagaccctgacgatcctcatccggaccggcctgctggtgatcagcggggtgttcccggtctccatccccatcaccgcggccgcctggtacctctgggaggtgaagaagcagcgcgccggcgtgctgtgggacgtccccagcccgccgcccgtggggaaggccgagctggaggacggcgcgtaccggatcaagcagcgcgggatcctcggctactcccagatcggcgccggggtgtacaaggagggcaccttccacaccatgtggcacgtcacgcgcggggccgtgctgatgcaccgcggcaagcggatcgagcccagctgggccgacgtgaagaaggacctgatctcctacgggggcggctggaagctcgagggggagtggaaggagggcgaggaggtccaggtgctggccctggagcccgggaagaacccccgcgcggtgcagaccaagcccggcctcttcaagaccaacaccgggacgatcggcgccgtcagcctggacttctcccccggcaccagcgggtcccccatcgtggaccggaagggcaaggtggtcgggctgtacggcaacggcgtggtgacccgcagcggggcctacgtctccgccatcgcgcagaccgagaagtccatcgaggacaaccccgagatcgaggacgacatcttccggaagaagcgcctcacgatcatggacctgcaccccggcgccgggaagaccaagcggtacctgcccgccatcgtgcgcgaggccatcaagcggggcctgcgcaccctcatcctggccccgacccgcgtggtcgcggccgagatggaggaggccctgcgggggctccccatccgctaccagacgcccgccatccgggccgagcacaccggccgcgagatcgtggacctgatgtgccacgcgaccttcaccatgcggctgctcagccccgtgcgcgtcccgaactacaacctgatcatcatggacgaggcccacttcacggaccccgcctccatcgccgcccggggctacatcagcacccgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggcgggcaacgacatcgccgcctgcctgcgcaagaacggcaagaaggtgatccagctcagccggaagaccttcgactccgagtacgtcaagacccgcgccaacgactgggacttcgtggtgacgaccgacatcagcgagatgggggccaacttcaaggcggagcgggtcatcgacccccgccggtgcatgaagcccgtgatcctgaccgacggcgaggagcgcgtgatcctggccgggcccatgccggtcacccactccagcgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacgcccgagggcatcatcccgtccatgttcgagcccgagcgcgagaaggtggacgccatcgacggggagtaccggctccgcggcgaggcccggaagaccttcgtggacctgatgcgccgcggggacctgcccgtctggctcgcctaccgcgtggccgcggagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctacagcgaccccctggccctgaaggagttcaaggagttcgcggccggccgcaagtccctcaccctgaacctgatcacggagatggggcggctccccaccttcatgacccagaaggcccgcgacgccctggacaacctggccgtgctccacaccgcggaggccggcgggcgggcctacaaccacgccctgagcgagctgcccgagacgctcgagaccctgctgctcctgaccctgctcgccaccgtcacgggcggcatcttcctgttcctgatgtccgggaagggcatcgggaagatgaccctcggcatgtgctgcatcatcaccgcgagcatcctgctgtggtacgcccagatccagccgcactggatcgccgcctccatcatcctcgagttcttcctgatcgtgctgctcatccccgagcccgagaagcagcgcacgccccaggacaaccagctgacctacgtggtcatcgccatcctgacggtggtggcggccaccatggccaacgagatggggttcctcgagaagaccaagaaggacctgggcctgggcagcatcaccacgcaggagagcgagtccaacatcctcgacatcgacctgcggccggccagcgcctggaccctgtacgcggtcgccaccaccttcgtgacgcccatgctccgccactccatcgagaacagctccgtgaacgtcagcctgaccgccatcgccaaccaggcgaccgtgctgatggggctcggcaaggggtggcccctgtccaagatggacatcggcgtgcccctgctcgccatcgggtgctacagccaggtcaacccgatcaccctgacggccgccctgctcctgctggtggcccactacgcgatcatcggccccggcctccaggccaaggccacccgggaggcccagaagcgcgccgcggccgggatcatgaagaaccccaccgtggacggcatcaccgtcatcgacctggagcccatcccgtacgaccccaagttcgagaagcagctggggcaggtcatgctcctgatcctgtgcgtgacgcaggtcctcatgatgcgcaccacctgggccctgtgcgaggccctgaccctcgccacgggccccatctccaccctgtgggaggggaaccccggccggttctggaacaccaccatcgcggtgagcatggccaacatcttccgcggctcctacctggccggggccggcctcctgttcagcatcatgaagaacacgaccaacacccggcgcgggaccggcaacatcggcgagacgctgggggagaagtggaagtcccggctcaacgcgctgggcaagaacgagttccagatctacaagaagtccgggatccaggaggtggaccgcaccctggccaaggagggcatcaagcgcggggagaccgaccaccacgccgtctcccgcggcagcgccaagctccggtggttcgtggagcgcaacatggtgatcccggagggcaaggtcgtggacctggggtgcggccgcggcgggtggtcctactactgcggcgggctgaagaacgtgcgcgaggtcaaggggctcaccaagggcgggcccgggcacgaggagcccatccccatgagcacgtacggctggaacctggtgcggctgcagtccggggtggacgtcttcttcaccccgcccgagaagtgcgacaccctcctgtgcgacatcggcgagagcagccccaaccccaccatcgaggccggccgcacgctgcgggtgctcaacctggtggagaactggctgaacaacaacacccagttctgcatcaaggtcctcaacccgtacatgccctccgtgatcgagaagatggagaccctgcagcgcaagtacgggggcgcgctggtgcggaaccccctgagccgcaactccacccacgagatgtactgggtcagcaacgccaccgggaacatcgtgtccagcgtgaacatgatctcccggatgctcatcaaccgcttcacgatgaagcacaagaaggccacctacgagccggacgtcgacctgggcagcgggacccgcaacatcggcatcgagtccgagatccccaacctggacatcatcggcaagcggatcgagaagatcaagcaggagcacgagaccagctggcactacgaccaggaccacccctacaagacgtgggcctaccacgggtcctacgagaccaagcagaccggcagcgcctccagcatggtgaacggggtggtccgcctcctgaccaagccctgggacgtggtgccgatggtcacgcagatggcgatgaccgacaccacccccttcggccagcagcgggtgttcaaggagaaggtggacacgcgcacccaggagcccaaggagggcaccaagaagctgatgaagatcaccgccgagtggctctggaaggagctggggaagaagaagacgccccggatgtgcacccgcgaggagttcacccggaaggtccgctccaacgccgccctgggcgccatcttcaccgacgagaacaagtggaagtccgcgcgggaggccgtggaggactcccgcttctgggagctcatcgaccgggagcgcaacctgcacctggaggggaagtgcgagacgtgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttctcccgcgggaacagcctgagcggcgtcgagggggagggcctccaccggctgggctacatcctgcgcgacgtgtccaagaaggagggcggggccatgtacgccgacgacaccgccgggtgggacacccggatcaccctcgaggacctgaagaacgaggagatggtcacgaaccacatgaagggcgagcacaagaagctggcggaggccatcttcaagctcacctaccagaacaaggtggtgcgcgtccagcggccgacgccccgggggaccgtgatggacatcatcagccgccgggaccagcgcggctccggccaggtggggacgtacggcctgaacaccttcaccaacatggaggcccagctgatccggcagatggagggggagggcatcttcaagagcatccagcacctcaccgtcacggaggagatcgccgtgcagaactggctggcccgcgtgggccgggagcgcctgtcccggatggcgatcagcggggacgactgcgtcgtgaagcccctcgacgaccgcttcgcctccgccctgaccgccctgaacgacatgggcaaggtgcggaaggacatccagcagtgggagcccagccgcgggtggaacgactggacccaggtcccgttctgctcccaccacttccacgagctcgtgatgaaggacggccgggtgctggtcgtgccctgccgcaaccaggacgagctgatcgggcgggcccgcatcagccagggcgcgggctggtccctcaaggagaccgcctgcctgggcaagagctacgcccagatgtggacgctgatgtacttccaccggcgcgacctccggctggccgccaacgcgatctgctccgccgtgcccagccactgggtccccacctcccgcaccacctggagcatccacgccaagcacgagtggatgaccacggaggacatgctggccgtgtggaaccgggtgtggatccaggagaacccgtggatggaggacaagacccccgtcgagtcctgggaggaggtgccctacctcggcaagcgcgaggaccagtggtgcgggagcctgatcggcctgaccagccgcgcgacctgggccaagaacatccagacggccatcaaccaggtgcggtccctcatcgggaacgaggagtacaccgactacatgcccagcatgaagcgcttccggcgcgaggaggaggaggccggcgtcctgtggtga

SEQ ID NO: 9376 - RNA, 9876 nt, synthetic construct
  misc_feature 1..9876: note = derived and/or modified CDS sequence (opt1) from DENV-2__EU482570__SS-prME
  source 1..9876: mol_type = other RNA
accgcgggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccgcaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctcgagaacctgatgtggaagcaggtcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggcgaagatgctgagcacggagtcccacaaccagaccttcctgatcgacgggcccgagaccgccgagtgcccgaacaccaaccgggcctggaacagcctcgaggtcgaggactacggcttcggggtgttcacgaccaacatctggctgaagctgcgcgagaagcaggacgtgttctgcgactccaagctcatgagcgccgccatcaaggacaaccgggcggtccacgccgacatgggctactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgccgggcccgtctcccagcacaactaccgcccgggctaccacacccagacggcggggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcgtgggcaccaagcacgcgatcctcctggtggccgtcagcttcgtgacgctgatcaccgggaacatgtccttccgggacctcggccgcgtgatggtcatggtgggggccaccatgaccgacgacatcggcatgggcgtgacgtacctggccctgctcgccgcgttcaaggtccgccccaccttcgccgccgggctgctgctccggaagctgaccagcaaggagctgatgatggccaccatcggcatcgccctcctgtcccagagcacgatccccgagaccatcctggagctcaccgacgcgctggccctggggatgatggtgctcaagatcgtgcgcaacatggagaagtaccagctggccgtcaccatcatggccatctcctgcgtgccgaacgccgtgatcctgcagaacgcgtggaaggtcggctgcacgatcctcgccgccgtgagcgtcagccccctgctgctcaccagctcccagcagaaggccgactggatccccctggcgctgaccatcaagggcctcaaccccaccgccatcttcctgacgaccctgagccggacctccaagaagcgcagctggccgctcaacgaggccatcatggccgtggggatggtgtccatcctggccagctccctgctcaagaacgacatccccatgaccggccccctggtcgccgggggcctgctcacggtgtgctacgtgctgaccgggcggagcgccgacctggagctcgagcgcgccgccgacgtcaagtgggaggaccaggccgagatcagcggctccagccccatcctgtccatcaccatcagcgaggacggctccatgagcatcaagaacgaggaggaggagcagaccctgacgatcctcatccggaccgggctgctggtgatctccggcgtgttcccggtcagcatccccatcaccgcggccgcctggtacctctgggaggtgaagaagcagcgcgccggggtgctgtgggacgtccccagcccgccgcccgtgggcaaggccgagctggaggacggggcgtaccggatcaagcagcgcggcatcctcggctacagccagatcggggccggcgtgtacaaggaggggaccttccacaccatgtggcacgtcacgcggggcgccgtgctgatgcaccgcgggaagcggatcgagccctcctgggccgacgtgaagaaggacctgatcagctacggcggcgggtggaagctcgagggcgagtggaaggagggggaggaggtccaggtgctggccctggagcccggcaagaacccccgcgcggtgcagaccaagcccggcctcttcaagaccaacaccggcacgatcggcgccgtctccctggacttcagccccgggacctccggcagccccatcgtggaccggaaggggaaggtggtcggcctgtacggcaacggggtggtgacccgctccggcgcctacgtcagcgccatcgcgcagaccgagaagtccatcgaggacaaccccgagatcgaggacgacatcttccggaagaagcgcctcacgatcatggacctgcaccccggggccggcaagaccaagcggtacctgcccgccatcgtgcgcgaggccatcaagcgggggctgcgcaccctcatcctggccccgacccgcgtggtcgcggccgagatggaggaggccctgcggggcctccccatccgctaccagacgcccgccatccgggccgagcacaccggccgcgagatcgtggacctgatgtgccacgcgaccttcaccatgcggctgctcagccccgtgcgcgtcccgaactacaacctgatcatcatggacgaggcccacttcacggaccccgccagcatcgccgcccgggggtacatctccacccgcgtggagatgggcgaggcggccgggatcttcatgaccgccacgccgcccggcagccgggacccgttcccccagtccaacgcccccatcatggacgaggagcgcgagatccccgagcggagctggaactccgggcacgagtgggtgacggacttcaagggcaagaccgtctggttcgtgccgagcatcaaggcgggcaacgacatcgccgcctgcctgcgcaagaacgggaagaaggtgatccagctctcccggaagaccttcgacagcgagtacgtcaagacccgcgccaacgactgggacttcgtggtgacgaccgacatctccgagatgggcgccaacttcaaggcggagcgggtcatcgacccccgccggtgcatgaagcccgtgatcctgaccgacggggaggagcgcgtgatcctggccggccccatgccggtcacccacagctccgccgcccagcggcgcgggcgcatcggccggaaccccaagaacgagaacgaccagtacatctacatgggcgagcccctcgagaacgacgaggactgcgcccactggaaggaggcgaagatgctgctggacaacatcaacacgcccgaggggatcatcccgagcatgttcgagcccgagcgcgagaaggtggacgccatcgacggcgagtaccggctccgcggggaggcccggaagaccttcgtggacctgatgcgccggggcgacctgcccgtctggctcgcctaccgcgtggccgcggaggggatcaactacgccgaccggcgctggtgcttcgacggcatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccgggcgcaagagcctcaccctgaacctgatcacggagatgggccggctccccaccttcatgacccagaaggcccgcgacgccctggacaacctggccgtgctccacaccgcggaggccgggggcaaggcctacaaccacgccctgtccgagctgcccgagacgctcgagaccctgctgctcctgaccctgctcgccaccgtcacgggcgggatcttcctgttcctgatgagcggcaaggggatcggcaagatgaccctcgggatgtgctgcatcatcaccgcgtccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgccatcctgacggtggtggcggccaccatggccaacgagatgggcttcctcgagaagaccaagaaggacctgggcctggggtccatcaccacgcaggagagcgagagcaacatcctcgacatcgacctgcgcccggcctccgcctggaccctgtacgcggtcgccaccaccttcgtgacgcccatgctccggcacagcatcgagaactccagcgtgaacgtctccctgaccgccatcgccaaccaggcgaccgtgctgatgggcctcgggaagggctggcccctgagcaagatggacatcggggtgcccctgctcgccatcggctgctactcccaggtcaacccgatcaccctgacggccgccctgctcctgctggtggcccactacgcgatcatcggccccgggctccaggccaaggccacccgcgaggcccagaagcgggccgcggccggcatcatgaagaaccccaccgtggacgggatcaccgtcatcgacctggagcccatcccgtacgaccccaagttcgagaagcagctgggccaggtgatgctcctgatcctgtgcgtgacgcaggtcctcatgatgcgcaccacctgggccctgtgcgaggccctgaccctcgccacggggcccatcagcaccctgtgggagggcaaccccggccgcttctggaacaccaccatcgcggtgtccatggccaacatcttccgggggagctacctggccggcgccgggctcctgttctccatcatgaagaacacgaccaacacccgccggggcaccggcaacatcggggagacgctgggcgagaagtggaagtcccgcctcaacgcgctggggaagtccgagttccagatctacaagaagtccggcatccaggaggtggaccggaccctggccaaggaggggatcaagcgcggcgagaccgaccaccacgccgtctcccggggcagcgccaagctccgctggttcgtggagcggaacatggtgaccccggaggggaaggtcgtggacctgggctgcgggcgcggcgggtggtcctactactgcggcggcctgaagaacgtgcgggaggtcaaggggctcacgaagggcgggcccggccacgaggagcccatccccatgagcacctacgggtggaacctggtgcgcctgcagtccggcgtggacgtcttcttcaccccgcccgagaagtgcgacaccctcctgtgcgacatcggcgagagcagccccaaccccacgatcgaggccgggcggaccctgcgcgtgctcaacctggtggagaactggctgaacaacaacacccagttctgcatcaaggtcctcaacccgtacatgccctccgtgatcgagaagatggagaccctgcagcggaagtacggcggggcgctggtgcgcaaccccctgagccggaactccacccacgagatgtactgggtcagcaacgccacgggcaacatcgtgtccagcgtgaacatgatctcccgcatgctcatcaaccggttcaccatgaagcacaagaaggccacctacgagccggacgtcgacctggggagcggcacccgcaacatcggcatcgagtccgagatccccaacctggacatcatcgggaagcgcatcgagaagatcaagcaggagcacgagacgagctggcactacgaccaggaccacccctacaagacctgggcctaccacggctcctacgagaccaagcagaccgggagcgcctccagcatggtgaacggcgtggtccggctcctgacgaagccctgggacgtggtgccgatggtcacccagatggcgatgaccgacaccacgcccttcggccagcagcgcgtgttcaaggagaaggtggacacccggacccaggagcccaaggaggggaccaagaagctgatgaagatcacggccgagtggctctggaaggagctgggcaagaagaagacgccccgcatgtgcacccgggaggagttcacccgcaaggtccggtccaacgccgccctgggggccatcttcacggacgagaacaagtggaagtccgcgcgcgaggccgtggaggactcccggttctgggagctcgtggaccgcgagcggaacctgcacctggagggcaagtgcgagacctgcgtctacaacatgatggggaagcgcgagaagaagctcggcgagttcggcaaggccaaggggagccgggccatctggtacatgtggctgggcgcgcgcttcctggagttcgaggccctcgggttcctgaacgaggaccactggttctcccggggcaacagcctgagcggggtggagggcgagggcctccaccgcctggggtacatcctgaaggacgtctccaagaaggagggcggggccatgtacgccgacgacaccgccggctgggacacccggatcacgctcgaggacctgaagaacgaggagatggtgaccaaccacatgaagggggagcacaagaagctggcggaggccatcttcaagctcacctaccagaacaaggtggtccgcgtgcagcggccgacgccccgcggcacggtgatggacatcatcagccggcgcgaccagcgcggctccgggcaggtcggcacctacgggctgaacaccttcaccaacatggaggcccagctgatccggcagatggagggcgagggcatcttcaagagcatccagcacctcacggtgaccgaggagatcgccgtgcagaactggctggcccgcgtcgggcgggagcgcctgtcccggatggtgatcagcggcgacgactgcgtggtcaagcccctcgacgaccgcttcgcgtccgccctgaccgccctgaacgacatggggaaggtgcggaaggacatccagcagtgggagcccagccgcggctggaacgactggacccaggtgccgttctgctcccaccacttccacgagctcgtcatgaaggacgggcgggtgctggtggtcccctgccgcaaccaggacgagctgatcggccgggcccgcatcagccagggcgccgggtggtccctcaaggagacggcgtgcctgggcaagagctacgcccagatgtggaccctgatgtacttccaccggcgcgacctccggctggccgccaacgccatctgctccgcggtgcccagccactgggtgcccacctcccgcaccacctggagcatccacgccaagcacgagtggatgacgaccgaggacatgctggccgtctggaaccgggtgtggatccaggagaacccgtggatggaggacaagacccccgtggagtcctgggaggaggtcccctacctcgggaagcgcgaggaccagtggtgcggcagcctgatcgggctgaccagccgggccacgtgggcgaagaacatccagaccgccatcaaccaggtgcgctccctcatcggcaacgaggagtacaccgactacatgcccagcatgaagcgcttccggcgcgaggaggaggaggccggcgtgctgtggtga

SEQ ID NO: 9377 - RNA, 9876 nt, synthetic construct
  misc_feature 1..9876: note = derived and/or modified CDS sequence (opt1) from DENV-2__EU482571__SS-prME
  source 1..9876: mol_type = other RNA
accgccggcgtgatcatcatgctgatccccaccgccatggcgttccacctcaccacccggaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgctgcccgagaacctcgagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctggacttcaacgagatggtgctcctgcagatggaggacaaggcctggctggtccaccggcagtggttcctcgacctgcccctgccctggctcccgggggccgacacccagggcagcaactggatccagaaggagacgctggtgaccttcaagaacccccacgcgaagaagcaggacgtggtcgtgctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctggggcgcctcatcaccgtgaacccgatcgtgaccgagaaggacagccccgtcaacatcgaggcggagccgcccttcggcgactcctacatcatcatcggggtggagccgggccagctgaagctgaactggttcaagaaggggagctccatcggccagatgttcgagaccacgatgcgcggcgccaagcggatggccatcctcggggacaccgcctgggacttcggcagcctcggcggggtgttcacctccatcgggaaggccctgcaccaggtcttcggggcgatctacggcgccgccttcagcggggtgtcctggaccatgaagatcctgatcggcgtgatcatcacgtggatcgggatgaacagccgctccaccagcctctccgtcagcctggtgctggtgggcgtcgtgaccctctacctgggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctcgcctccgccatccagaaggcccacgaggagggcatctgcgggatccggagcgtcacccgcctggagaacctgatgtggaagcagatcacccccgagctcaaccacatcctgtccgagaacgaggtgaagctgacgatcatgaccggcgacatcaaggggatcatgcaggccggcaagcggagcctccgcccgcagcccaccgagctgaagtactcctggaagacctggggcaaggcgaagatgctgagcacggagtcccacaaccagaccttcctcatcgacgggcccgagaccgccgagtgcccgaacaccaaccgggcctggaacagcctggaggtggaggactacggcttcggggtcttcacgaccaacatctggctgaagctccgcgagaagcaggacgtgttctgcgactccaagctgatgagcgccgccatcaaggacaaccgggcggtgcacgccgacatgggctactggatcgagtccgccctgaacgacacctggaagatggagaaggccagcttcatcgaggtcaagtcctgccactggcccaagagccacaccctctggtccaacggcgtgctggagagcgagatgatcatccccaagaacttcgccgggcccgtgtcccagcacaactaccgcccgggctaccacacccagacggcggggccctggcacctgggcaagctcgagatggacttcgacttctgcgaggggaccaccgtcgtggtgaccgaggactgcggcaaccggggccccagcctgcgcacgaccaccgccagcgggaagctgatcaccgagtggtgctgccggtcctgcacgctgccgcccctgcgctaccggggcgaggacgggtgctggtacggcatggagatccgccccctgaaggagaaggaggagaacctcgtcaacagcctggtgaccgccgggcacggccagatcgacaacttctccctgggcgtgctcgggatggccctgttcctggaggagatgctccggacccgcgtcggcaccaagcacgcgatcctgctggtggccgtgagcttcgtcacgctcatcaccgggaacatgtccttccgggacctgggccgcgtgatggtgatggtcggggccaccatgaccgacgacatcggcatgggcgtgacgtacctggccctcctggccgcgttcaaggtgcgccccaccttcgccgccgggctgctcctgcggaagctgaccagcaaggagctcatgatggccaccatcggcatcgccctgctgtcccagagcacgatccccgagaccatcctcgagctgaccgacgcgctggccctcgggatgatggtcctgaagatcgtgcgcaacatggagaagtaccagctggccgtgaccatcatggccatctcctgcgtccccaacgccgtgatcctccagaacgcgtggaaggtgagctgcacgatcctggccgccgtctccgtgagccccctgctcctgacctccagccagcagaaggccgactggatccccctggcgctcaccatcaagggcctgaaccccaccgccatcttcctgacgaccctctcccggaccagcaagaagcgctcctggccgctgaacgaggccatcatggccgtcggcatggtgagcatcctggcctccagcctcctgaagaacgacatccccatgaccgggcccctggtggcgggcgggctcctgacggtctgctacgtgctgaccggccggagcgccgacctcgagctggagcgcgccgccgacgtgaagtgggaggaccaggccgagatctccgggagctcccccatcctgagcatcaccatctccgaggacggcagcatgtccatcaagaacgaggaggaggagcagaccctcacgatcctgatccggaccggcctgctcgtcatcagcggggtgttcccggtgtccatccccatcaccgcggccgcctggtacctgtgggaggtcaagaagcagcgcgccggcgtgctgtgggacgtgccctccccgccgcccgtcgggaaggccgagctcgaggacggcgcgtaccggatcaagcagcgcgggatcctgggctactcccagatcggcgccggggtgtacaaggagggcaccttccacaccatgtggcacgtgacgcgcggggccgtcctgatgcaccgcggcaagcggatcgagcccagctgggccgacgtgaagaaggacctcatctcctacgggggcggctggaagctggagggggagtggaaggagggcgaggaggtgcaggtcctggccctcgagcccgggaagaacccccgcgcggtgcagaccaagcccggcctgttcaagaccaacaccgggacgatcggcgccgtgagcctggacttctcccccggcaccagcgggtcccccatcgtcgaccggaagggcaaggtggtggggctctacggcaacggcgtcgtgacccgcagcggggcctacgtgtccgccatcgcgcagaccgagaagtccatcgaggacaaccccgagatcgaggacgacatcttccggaagaagcgcctgacgatcatggacctgcaccccggcgccgggaagaccaagcggtacctgcccgccatcgtccgcgaggccatcaagcggggcctccgcaccctgatcctggccccgacccgcgtggtggcggccgagatggaggaggccctccgggggctgcccatccgctaccagacgcccgccatccgggccgagcacaccggccgcgagatcgtcgacctgatgtgccacgcgaccttcaccatgcggctcctgagccccgtgcgcgtgccgaactacaacctgatcatcatggacgaggcccacttcacggaccccgcctccatcgccgcccggggctacatcagcacccgcgtcgagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtgtggttcgtcccgtccatcaaggcgggcaacgacatcgccgcctgcctccgcaagaacggcaagaaggtgatccagctgagccggaagaccttcgactccgagtacgtgaagacccgcgccaacgactgggacttcgtcgtgacgaccgacatcagcgagatgggggccaacttcaaggcggagcgggtgatcgacccccgccggtgcatgaagcccgtcatcctgaccgacggcgaggagcgcgtgatcctcgccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacgcccgagggcatcatcccgtccatgttcgagcccgagcgcgagaaggtcgacgccatcgacggggagtaccggctgcgcggcgaggcccggaagaccttcgtggacctgatgcgccgcggggacctccccgtgtggctggcctaccgcgtcgccgcggagggcatcaactacgccgaccggcgctggtgcttcgacgggatcaagaacaaccagatcctggaggagaacgtggaggtggagatctggaccaaggagggcgagcggaagaagctcaagccgcgctggctggacgcccggatctacagcgaccccctggccctcaaggagttcaaggagttcgcggccggccgcaagtccctgaccctgaacctcatcacggagatggggcggctgcccaccttcatgacccagaaggcccgcgacgccctggacaacctcgccgtcctgcacaccgcggaggccggcgggcgggcctacaaccacgccctgagcgagctccccgagacgctggagaccctgctcctgctgaccctcctggccaccgtgacgggcggcatcttcctgttcctcatgtccgggaagggcatcgggaagatgaccctgggcatgtgctgcatcatcaccgcgagcatcctgctctggtacgcccagatccagccgcactggatcgccgcctccatcatcctggagttcttcctgatcgtcctcctgatccccgagcccgagaagcagcgcacgccccaggacaaccagctgacctacgtggtgatcgccatcctcacggtcgtggcggccaccatggccaacgagatggggttcctggagaagaccaagaaggacctgggcctcggcagcatcaccacgcaggagagcgagtccaacatcctggacatcgacctgcggccggccagcgcctggaccctctacgcggtggccaccaccttcgtcacgcccatgctgcgccactccatcgagaacagctccgtgaacgtgagcctgaccgccatcgccaaccaggcgaccgtcctcatggggctgggcaaggggtggcccctgtccaagatggacatcggcgtgcccctcctggccatcgggtgctacagccaggtgaacccgatcaccctgacggccgccctcctgctgctcgtcgcccactacgcgatcatcggccccggcctgcaggccaaggccacccgggaggcccagaagcgcgccgcggccgggatcatgaagaaccccaccgtggacggcatcaccgtgatcgacctggagcccatcccgtacgaccccaagttcgagaagcagctcgggcaggtcatgctgctgatcctctgcgtgacccaggtgctgatgatgcgcaccacctgggccctgtgcgaggccctcaccctggccacgggccccatctccaccctgtgggaggggaaccccggccggttctggaacaccaccatcgcggtcagcatggccaacatcttccgcggctcctacctcgccggggccggcctgctgttcagcatcatgaagaacacgaccaacacccggcgcgggaccggcaacatcggcgagacgctcggggagaagtggaagtcccggctgaacgcgctgggcaagagcgagttccagatctacaagaagtccgggatccaggaggtggaccgcaccctcgccaaggagggcatcaagcgcggggagaccgaccaccacgccgtgagccgcggctccgccaagctgcggtggttcgtcgagcgcaacatggtgaccccggagggcaaggtggtcgacctggggtgcggccgcgggggctggagctactactgcgggggcctcaagaacgtgcgcgaggtgaagggcctgacgaagggcggccccgggcacgaggagcccatccccatgtccacctacggctggaacctggtccggctccagagcggggtggacgtgttcttcaccccgcccgagaagtgcgacaccctgctgtgcgacatcggcgagagctcccccaaccccacgatcgaggccggccgcaccctccgggtcctgaacctggtggagaactggctcaacaacaacacccagttctgcatcaaggtgctgaacccgtacatgcccagcgtcatcgagaagatggagaccctgcagcgcaagtacgggggcgcgctggtgcggaaccccctctcccgcaacagcacccacgagatgtactgggtgtccaacgccacggggaacatcgtcagctccgtgaacatgatcagccggatgctgatcaaccgcttcaccatgaagcacaagaaggccacctacgagccggacgtggacctgggctccgggacccgcaacatcggcatcgagagcgagatccccaacctcgacatcatcggcaagcggatcgagaagatcaagcaggagcacgagacgtcctggcactacgaccaggaccacccctacaagacctgggcctaccacgggagctacgagaccaagcagaccggctccgccagctccatggtcaacggggtggtgcgcctgctgacgaagccctgggacgtcgtgccgatggtgacccagatggcgatgaccgacaccacgcccttcggccagcagcgggtcttcaaggagaaggtggacacccgcacccaggagcccaaggagggcaccaagaagctcatgaagatcacggccgcctggctgtggaaggagctggggaagaagaagacgccccggatgtgcacccgcgaggagttcacccggaaggtgcgcagcaacgccgccctcggcgcgatcttcacggacgagaacaagtggaagtccgcccgggaggccgtcgaggacagccgcttctgggagctgatcgaccgggagcgcaacctgcacctcgaggggaagtgcgagacctgcgtgtacaacatgatgggcaagcgggagaagaagctgggggagttcggcaaggccaagggctcccgcgcgatctggtacatgtggctgggggcccggttcctcgagttcgaggccctgggcttcctgaacgaggaccactggttcagccgcgggaacagcctctccggcgtggagggggagggcctgcaccggctgggctacatcctccgcgacgtcagcaagaaggagggcggcgccatgtacgccgacgacaccgcggggtgggacacccggatcacgctggaggacctgaagaacgaggagatggtgaccaaccacatgaagggcgagcacaagaagctcgccgaggccatcttcaagctgacctaccagaacaaggtcgtgcgcgtgcagcggccgacgccccgcgggaccgtcatggacatcatctcccgccgggaccagcgcggcagcggccaggtggggacctacggcctgaacaccttcaccaacatggaggcccagctcatccggcagatggagggggagggcatcttcaagtccatccagcacctgacggtgaccgaggagatcgccgtccagaactggctggcgcgcgtgggccgggagcgcctcagccggatggccatctccggggacgactgcgtggtcaagcccctggacgaccgcttcgccagcgccctgaccgccctcaacgacatgggcaaggtgcggaaggacatccagcagtgggagccctcccgcgggtggaacgactggacccaggtgccgttctgcagccaccacttccacgagctggtcatgaaggacggccgggtgctggtggtcccctgccgcaaccaggacgagctcatcgggcgggcgcgcatctcccagggcgccggctggagcctgaaggagacggcctgcctggggaagtcctacgcccagatgtggaccctcatgtacttccaccggcgcgacctgcggctggccgcgaacgccatctgcagcgccgtgccctcccactgggtgcccaccagccgcaccacctggtccatccacgccaagcacgagtggatgacgaccgaggacatgctcgcggtctggaaccgggtgtggatccaggagaacccgtggatggaggacaagacccccgtggagagctgggaggaggtcccctacctgggcaagcgcgaggaccagtggtgcgggagcctgatcggcctcacctcccgcgccacgtgggccaagaacatccagaccgccatcaaccaggtgcggagcctgatcgggaacgaggagtacaccgactacatgccctccatgaagcgcttccggcgcgaggaggaggaggccggcgtgctgtggtga

SEQ ID NO: 9378 - RNA, 9876 nt, synthetic construct
  misc_feature 1..9876: note = derived and/or modified CDS sequence (opt1) from DENV-2__EU482572__SS-prME
  source 1..9876: mol_type = other RNA
accgcgggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctcgagaacctgatgtggaagcaggtcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggcgaagatgctgagcacggagtcccacaaccagaccttcctgatcgacgggcccgagaccgccgagtgcccgaacaccaaccgggcctggaacagcctcgaggtcgaggactacggcttcggggtgttcacgaccaacatctggctgaagctgcgcgagaagcaggacgtgttctgcgactccaagctcatgagcgccgccatcaaggacaaccgggcggtccacgccgacatgggctactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgccgggcccgtctcccagcacaactaccgcccgggctaccacacccagacggcggggccctggcacctgggcaagctggagatggacttcgacttctgcgaggggaccaccgtggtggtcaccggcgactgcggcaaccgggggcccagcctccgcacgaccaccgccagcggcaagctgatcaccgagtggtgctgccggtcctgcacgctgcccccgctccgctaccgcggggaggacggctgctggtacgggatggagatccgccccctgaaggagaaggaggagaacctggtgaacagcctcgtgaccgccggccacggccagatcgacaacttctccctgggggtcctgggcatggccctcttcctggaggagatgctgcggacccgcgtggggaccaagcacgcgatcctcctggtggccgtcagcttcgtgacgctgatcaccggcaacatgtccttccgggacctcgggcgcgtgatggtcatggtgggcgccaccatgaccgacgacatcggcatgggggtgacgtacctggccctgctcgccgcgttcaaggtccgccccaccttcgccgccggcctgctgctccggaagctgaccagcaaggagctgatgatggccaccatcgggatcgccctcctgtcccagagcacgatccccgagaccatcctggagctcaccgacgcgctggccctgggcatgatggtgctcaagatcgtgcgcaacatggagaagtaccagctggccgtcaccatcatggccatctcctgcgtgccgaacgccgtgatcctgcagaacgcgtggaaggtcagctgcacgatcctcgccgtggtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccatcatggccgtggggatggtcagcatcctggcctccagcctgctcaagaacgacatccccatgaccggccccctggtggccgggggcctgctcacggtgtgctacgtcctgaccgggcggagcgcggacctggagctcgagcgcgccgccgacgtgaagtgggaggaccaggccgagatctccggcagctcccccatcctgagcatcaccatctccgaggacggcagcatgtccatcaagaacgaggaggaggagcagaccctgacgatcctcatccggaccgggctgctggtgatcagcggcgtcttcccggtgtccatccccatcaccgccgcggcctggtacctctgggaggtgaagaagcagcgcgccggggtcctgtgggacgtgcccagcccgccgcccgtgggcaaggccgagctggaggacggggcctaccggatcaagcagcgcggcatcctcggctactcccagatcggggcgggcgtctacaaggaggggaccttccacaccatgtggcacgtgacgcggggcgccgtgctgatgcaccgcgggaagcggatcgagcccagctgggccgacgtcaagaaggacctgatctcctacggcggcgggtggaagctcgagggcgagtggaaggagggggaggaggtccaggtgctggccctggagcccggcaagaacccccgcgccgtccagaccaagcccggcctgttcaagaccaacaccggcacgatcggcgcggtgagcctggacttctcccccgggaccagcggctcccccatcgtggaccggaaggggaaggtcgtgggcctgtacggcaacggggtggtcacccgcagcggcgcctacgtgtccgccatcgcccagaccgagaagtccatcgaggacaaccccgagatcgaggacgacatcttccggaagaagcgcctcacgatcatggacctgcaccccggggcgggcaagaccaagcggtacctgcccgccatcgtgcgcgaggccatcaagcgggggctgcgcaccctcatcctggccccgacccgcgtcgtggccgcggagatggaggaggccctgcggggcctccccatccgctaccagacgcccgccatccgggccgagcacaccggccgcgagatcgtggacctgatgtgccacgccaccttcaccatgcggctgctcagccccgtccgcgtgccgaactacaacctgatcatcatggacgaggcgcacttcacggaccccgcctccatcgccgcccgggggtacatcagcacccgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtcacggacttcaagggcaagaccgtgtggttcgtgccgtccatcaaggccggcaacgacatcgcggcctgcctgcgcaagaacgggaagaaggtcatccagctcagccggaagaccttcgactccgagtacgtgaagacccgcgccaacgactgggacttcgtggtcacgaccgacatcagcgagatgggcgccaacttcaaggccgagcgggtgatcgacccccgccggtgcatgaagcccgtgatcctgaccgacggggaggagcgcgtcatcctggcgggccccatgccggtgacccactccagcgccgcccagcggcgcgggcgcatcggccggaaccccaagaacgagaacgaccagtacatctacatgggcgagcccctcgagaacgacgaggactgcgcccactggaaggaggccaagatgctgctggacaacatcaacacgcccgaggggatcatcccgtccatgttcgagcccgagcgcgagaaggtggacgcgatcgacggcgagtaccggctccgcggggaggcccggaagaccttcgtcgacctgatgcgccggggcgacctgcccgtgtggctcgcctaccgcgtggccgccgaggggatcaactacgcggaccggcgctggtgcttcgacggcatcaagaacaaccagatcctggaggagaacgtcgaggtggagatctggaccaaggagggcgagcggaagaagctgaagccgcgctggctcgacgcccggatctacagcgaccccctggccctgaaggagttcaaggagttcgccgcggggcgcaagtccctcaccctgaacctgatcacggagatgggccggctccccaccttcatgacccagaaggcccgcgacgccctggacaacctggccgtcctccacaccgccgaggccggcgggaaggcctacaaccacgccctgagcgagctgcccgagacgctcgagaccctgctgctcctgaccctgctcgccaccgtgacgggcgggatcttcctgttcctgatgtccgggaaggggatcggcaagatgaccctcgggatgtgctgcatcatcaccgccagcatcctgctgtggtacgcgcagatccagccgcactggatcgccgcctccatcatcctcgagttcttcctgatcgtgctgctcatccccgagcccgagaagcagcggacgccccaggacaaccagctgacctacgtcgtgatcgccatcctgacggtggtcgccgcgaccatggccaacgagatgggcttcctcgagaagaccaagaaggacctgggcctggggagcatcaccacgcaggagagcgagtccaacatcctcgacatcgacctgcgcccggccagcgcctggaccctgtacgccgtggcgaccaccttcgtgacgcccatgctccggcactccatcgagaacagctccgtcaacgtgagcctgaccgccatcgccaaccaggccaccgtgctgatgggcctcgggaagggctggcccctgtccaagatggacatcggggtccccctgctcgcgatcggctgctacagccaggtgaacccgatcaccctgacggccgccctgctcctgctggtggcccactacgccatcatcggccccgggctccaggcgaaggccacccgcgaggcccagaagcgggccgccgcgggcatcatgaagaaccccaccgtcgacgggatcaccgtgatcgacctggagcccatcccgtacgaccccaagttcgagaagcagctgggccaggtgatgctcctgatcctgtgcgtcacccaggtgatgatgatgcgcaccacctgggccctctgcgaggccctgaccctggccacggggcccatctccaccctctgggagggcaaccccggccgcttctggaacaccaccatcgccgtgagcatggcgaacatcttccgggggtcctacctggccggcgccgggctcctcttcagcatcatgaagaacacgaccaacacccgccggggcaccggcaacatcggggagacgctgggcgagaagtggaagtcccgcctgaacgccctcggcaagagcgagttccagatctacaagaagtccggcatccaggaggtcgaccggaccctggcgaaggaggggatcaagcgcggcgagaccgaccaccacgccgtgagccggggctccgccaagctgcgctggttcgtggagcggaacatggtcaccccggaggggaaggtggtggacctcggctgcgggcgcggcgggtggagctactactgcggcggcctgaagaacgtccgggaggtgaaggggctgacgaagggcgggcccggccacgaggagcccatccccatgtccacctacgggtggaacctcgtgcgcctgcagagcggcgtcgacgtgttcttcaccccgcccgagaagtgcgacaccctgctctgcgacatcggcgagagctcccccaaccccacgatcgaggccgggcggaccctgcgcgtgctgaacctcgtcgagaactggctgaacaacaacacccagttctgcatcaaggtgctgaacccgtacatgcccagcgtgatcgagaagatggagaccctccagcggaagtacggcggggccctggtccgcaaccccctgtcccggaacagcacccacgagatgtactgggtgtccaacgcgacgggcaacatcgtgagctccgtcaacatgatcagccgcatgctgatcaaccggttcaccatgaagcacaagaaggccacctacgagccggacgtggacctcgggtccggcacccgcaacatcggcatcgagagcgagatccccaacctggacatcatcgggaagcgcatcgagaagatcaagcaggagcacgagacgtcctggcactacgaccaggaccacccctacaagacctgggcctaccacggcagctacgaggccaagcagaccgggtccgccagctccatggtgaacggcgtcgtgcggctgctcaccaagccctgggacgtggtcccgatggtgacgcagatggcgatgaccgacaccacccccttcggccagcagcgcgtgttcaaggagaaggtcgacacgcggacccaggagcccaaggaggggaccaagaagctgatgaagatcaccgccgagtggctgtggaaggagctcggcaagaagaagacgccccgcatgtgcacccgggaggagttcacccgcaaggtgcggagcaacgccgccctgggggccatcttcaccgacgagaacaagtggaagtccgcgcgcgaggccgtggaggacagccggttctgggagctggtcgaccgcgagcggaacctccacctggagggcaagtgcgagacgtgcgtgtacaacatgatggggaagcgcgagaagaagctgggcgagttcggcaaggccaaggggtcccgggccatctggtacatgtggctcggcgcgcgcttcctggagttcgaggccctggggttcctcaacgaggaccactggttcagccggggcaacagcctgtccggggtcgagggcgagggcctgcaccgcctcgggtacatcctgcgggacgtgagcaagaaggagggcggggccatgtacgccgacgacaccgccggctgggacacccgcatcaccctggaggacctcaagaacgaggagatggtgacgaaccacatgaagggggagcacaagaagctggcggaggccatcttcaagctgacctaccagaacaaggtcgtgcgggtgcagcgcccgacgccccggggcaccgtcatggacatcatctcccgccgcgaccagcggggcagcggccaggtggggacgtacgggctcaacaccttcaccaacatggaggcccagctgatccgccagatggagggcgagggcatcttcaagtccatccagcacctgaccgtgacggaggagatcgccgtccagaactggctcgcccgggtggggcgcgagcggctgagccgcatggtgatctccggcgacgactgcgtcgtgaagcccctggacgaccggttcgcgagcgccctcaccgccctgaacgacatggggaaggtgcgcaaggacatccagcagtgggagccctcccggggctggaacgactggacccaggtcccgttctgcagccaccacttccacgagctggtgatgaaggacgggcgcgtgctcgtcgtgccctgccggaaccaggacgagctgatcggccgcgcccggatctcccagggcgccgggtggagcctgaaggagaccgcgtgcctcggcaagtcctacgcccagatgtggacgctgatgtacttccaccgccgggacctgcgcctcgccgccaacgccatctgcagcgcggtgccctcccactgggtccccaccagccggaccacctggtccatccacgccaagcacgagtggatgaccacggaggacatgctggccgtgtggaaccgcgtgtggatccaggagaacccgtggatggaggacaagacccccgtcgagagctgggaggaggtgccctacctggggaagcgggaggaccagtggtgcggcagcctcatcgggctgacctcccgcgccacctgggcgaagaacatccagacggccatcaaccaggtgcgcagcctgatcggcaacgaggagtacaccgactacatgccctccatgaagcggttccgccgggaggaggaggaggccggcgtcctctggtga

SEQ ID NO: 9379 - RNA, 9876 nt, synthetic construct
  misc_feature 1..9876: note = derived and/or modified CDS sequence (opt1) from DENV-2__EU482573__SS-prME
  source 1..9876: mol_type = other RNA
accgccggcgtgatcatcatgctgatccccaccgccatggcgttccacctcaccacccggaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgctgcccgagaacctcgagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctggacttcaacgagatggtgctcctgcagatggaggacaaggcctggctggtccaccggcagtggttcctcgacctgcccctgccctggctcccgggggccgacacccagggcagcaactggatccagaaggagacgctggtgaccttcaagaacccccacgcgaagaagcaggacgtggtcgtgctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctggggcgcctcatcaccgtgaacccgatcgtgaccgagaaggacagccccgtcaacatcgaggcggagccgcccttcggcgactcctacatcatcatcggggtggagccgggccagctgaagctgaactggttcaagaaggggagctccatcggccagatgttcgagaccacgatgcgcggcgccaagcggatggccatcctcggggacaccgcctgggacttcggcagcctcggcggggtgttcacctccatcgggaaggccctgcaccaggtcttcggggcgatctacggcgccgccttcagcggggtgtcctggaccatgaagatcctgatcggcgtgatcatcacgtggatcgggatgaacagccgctccaccagcctctccgtcagcctggtgctggtgggcgtcgtgaccctctacctgggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctcgcctccgccatccagaaggcccacgaggagggcatctgcgggatccggagcgtcacccgcctggagaacctgatgtggaagcagatcacccccgagctcaaccacatcctgtccgagaacgaggtgaagctgacgatcatgaccggcgacatcaaggggatcatgcaggccggcaagcggagcctccgcccgcagcccaccgagctgaagtactcctggaagacctggggcaaggcgaagatgctgagcacggagtcccacaaccagaccttcctcatcgacgggcccgagaccgccgagtgcccgaacaccaaccgggcctggaacagcctggaggtggaggactacggcttcggggtcttcacgaccaacatctggctgaagctccgcgagaagcaggacgtgttctgcgactccaagctgatgagcgccgccatcaaggacaaccgggcggtgcacgccgacatgggctactggatcgagtccgccctgaacgacacctggaagatggagaaggccagcttcatcgaggtcaagtcctgccactggcccaagagccacaccctctggtccaacggcgtgctggagagcgagatgatcatccccaagaacttcgccgggcccgtgtcccagcacaactaccgcccgggctaccacacccagacggcggggccctggcacctgggcaagctcgagatggacttcgacttctgcgaggggaccaccgtcgtggtgaccgaggactgcggcaaccggggccccagcctgcgcacgaccaccgccagcgggaagctgatcaccgagtggtgctgccggtcctgcacgctgccgcccctgcgctaccggggcgaggacgggtgctggtacggcatggagatccgccccctgaaggagaaggaggagaacctcgtcaacagcctggtgaccgccgggcacggccagatcgacaacttctccctgggcgtgctcgggatggccctgttcctggaggagatgctccggacccgcgtcggcaccaagcacgcgatcctgctggtggccgtgagcttcgtcacgctcatcaccgggaacatgtccttccgggacctgggccgcgtgatggtgatggtcggggccaccatgaccgacgacatcggcatgggcgtgacgtacctggccctcctggccgcgttcaaggtgcgccccaccttcgccgccgggctgctcctgcggaagctgaccagcaaggagctcatgatggccaccatcggcatcgccctgctgtcccagagcacgatccccgagaccatcctcgagctgaccgacgcgctggccctcgggatgatggtcctgaagatcgtgcgcaacatggagaagtaccagctggccgtgaccatcatggccatctcctgcgtccccaacgccgtgatcctccagaacgcgtggaaggtgagctgcacgatcctggccgccgtctccgtgagccccctgctcctgacctccagccagcagaaggccgactggatccccctggcgctcaccatcaagggcctgaaccccaccgccatcttcctgacgaccctctcccggaccagcaagaagcgctcctggccgctgaacgaggccatcatggccgtcggcatggtgagcatcctggcctccagcctcctgaagaacgacatccccatgaccgggcccctggtggcgggcgggctcctgacggtctgctacgtgctgaccggccggagcgccgacctcgagctggagcgcgccgccgacgtgaagtgggaggaccaggccgagatctccgggagctcccccatcctgagcatcaccatctccgaggacggcagcatgtccatcaagaacgaggaggaggagcagaccctcacgatcctgatccggaccggcctgctcgtcatcagcggggtgttcccggtgtccatccccatcaccgcggccgcctggtacctgtgggaggtcaagaagcagcgcgccggcgtgctgtgggacgtgccctccccgccgcccgtcgggaaggccgagctcgaggacggcgcgtaccggatcaagcagcgcgggatcctgggctactcccagatcggcgccggggtgtacaaggagggcaccttccacaccatgtggcacgtgacgcgcggggccgtcctgatgcaccgcggcaagcggatcgagcccagctgggccgacgtgaagaaggacctcatctcctacgggggcggctggaagctggagggggagtggaaggagggcgaggaggtgcaggtcctggccctcgagcccgggaagaacccccgcgcggtgcagaccaagcccggcctgttcaagaccaacaccgggacgatcggcgccgtgagcctggacttctcccccggcaccagcgggtcccccatcgtcgaccggaagggcaaggtggtggggctctacggcaacggcgtcgtgacccgcagcggggcctacgtgtccgccatcgcgcagaccgagaagtccatcgaggacaaccccgagatcgaggacgacatcttccggaagaagcgcctgacgatcatggacctgcaccccggcgccgggaagaccaagcggtacctgcccgccatcgtccgcgaggccatcaagcggggcctccgcaccctgatcctggccccgacccgcgtggtggcggccgagatggaggaggccctccgggggctgcccatccgctaccagacgcccgccatccgggccgagcacaccggccgcgagatcgtcgacctgatgtgccacgcgaccttcaccatgcggctcctgagccccgtgcgcgtgccgaactacaacctgatcatcatggacgaggcccacttcacggaccccgcctccatcgccgcccggggctacatcagcacccgcgtcgagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtgtggttcgtcccgtccatcaaggcgggcaacgacatcgccgcctgcctccgcaagaacggcaagaaggtgatccagctgagccggaagaccttcgactccgagtacgtgaagacccgcgccaacgactgggacttcgtcgtgacgaccgacatcagcgagatgggggccaacttcaaggcggagcgggtgatcgacccccgccggtgcatgaagcccgtcatcctgaccgacggcgaggagcgcgtgatcctcgccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacgcccgagggcatcatcccgtccatgttcgagcccgagcgcgagaaggtcgacgccatcgacggggagtaccggctgcgcggcgaggcccggaagaccttcgtggacctgatgcgccgcggggacctccccgtgtggctggcctaccgcgtcgccgcggagggcatcaactacgccgaccggcgctggtgcttcgacgggatcaagaacaaccagatcctggaggagaacgtggaggtggagatctggaccaaggagggcgagcggaagaagctcaagccgcgctggctggacgcccggatctacagcgaccccctggccctcaaggagttcaaggagttcgcggccggccgcaagtccctgaccctgaacctcatcacggagatggggcggctgcccaccttcatgacccagaaggcccgcgacgccctggacaacctcgccgtcctgcacaccgcggaggccggcgggcgggcctacaaccacgccctgagcgagctccccgagacgctggagaccctgctcctgctgaccctcctggccaccgtgacgggcggcatcttcctgttcctcatgtccgggaagggcatcgggaagatgaccctgggcatgtgctgcatcatcaccgcgagcatcctgctctggtacgcccagatccagccgcactggatcgccgcctccatcatcctggagttcttcctgatcgtcctcctgatccccgagcccgagaagcagcgcacgccccaggacaaccagctgacctacgtggtgatcgccatcctcacggtcgtggcggccaccatggccaacgagatggggttcctggagaagaccaagaaggacctgggcctcggcagcatcaccacgcaggagagcgagtccaacatcctggacatcgacctgcggccggccagcgcctggaccctctacgcggtggccaccaccttcgtcacgcccatgctgcgccactccatcgagaacagctccgtgaacgtgagcctgaccgccatcgccaaccaggcgaccgtcctcatggggctgggcaaggggtggcccctgtccaagatggacatcggcgtgcccctcctggccatcgggtgctacagccaggtgaacccgatcaccctgacggccgccctcctgctgctcgtcgcccactacgcgatcatcggccccggcctgcaggccaaggccacccgggaggcccagaagcgcgccgcggccgggatcatgaagaaccccaccgtggacggcatcaccgtgatcgacctggagcccatcccgtacgaccccaagttcgagaagcagctcgggcaggtcatgctgctgatcctctgcgtgacccaggtgctgatgatgcgcaccacctgggccctgtgcgaggccctcaccctggccacgggccccatctccaccctgtgggaggggaaccccggccggttctggaacaccaccatcgcggtcagcatggccaacatcttccgcggctcctacctcgccggggccggcctgctgttcagcatcatgaagaacacgaccaacacccggcgcgggaccggcaacatcggcgagacgctcggggagaagtggaagtcccggctgaacgcgctgggcaagagcgagttccagatctacaagaagtccgggatccaggaggtggaccgcaccctcgccaaggagggcatcaagcgcggggagaccgaccaccacgccgtgagccgcggctccgccaagctgcggtggttcgtcgagcgcaacatggtgaccccggagggcaaggtggtcgacctggggtgcggccgcgggggctggagctactactgcgggggcctcaagaacgtgcgcgaggtgaagggcctgacgaagggcggccccgggcacgaggagcccatccccatgtccacctacggctggaacctggtccggctccagagcggggtggacgtgttcttcaccccgcccgagaagtgcgacaccctgctgtgcgacatcggcgagagctcccccaaccccacgatcgaggccggccgcaccctccgggtcctgaacctggtggagaactggctcaacaacaacacccagttctgcatcaaggtgctgaacccgtacatgcccagcgtcatcgagaagatggagaccctgcagcgcaagtacgggggcgcgctggtgcggaaccccctctcccgcaacagcacccacgagatgtactgggtgtccaacgccacggggaacatcgtcagctccgtgaacatgatcagccggatgctgatcaaccgcttcaccatgaagcacaagaaggccacctacgagccggacgtggacctgggctccgggacccgcaacatcggcatcgagagcgagatccccaacctcgacatcatcggcaagcggatcgagaagatcaagcaggagcacgagacgtcctggcactacgaccaggaccacccctacaagacctgggcctaccacgggagctacgagaccaagcagaccggctccgccagctccatggtcaacggggtggtgcgcctgctgacgaagccctgggacgtcgtgccgatggtgacccagatggcgatgaccgacaccacgcccttcggccagcagcgggtcttcaaggagaaggtggacacccgcacccaggagcccaaggagggcaccaagaagctcatgaagatcacggccgagtggctgtggaaggagctggggaagaagaagacgccccggatgtgcacccgcgaggagttcacccggaaggtgcgcagcaacgccgccctcggcgccatcttcacggacgagaacaagtggaagtccgcgcgggaggccgtcgaggacagccgcttctgggagctgatcgaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtggagggggagggcctgcaccggctgggctacatcctccgcgacgtcagcaagaaggagggcggcgccatgtacgccgacgacaccgccgggtgggacacccggatcacgctggaggacctgaagaacgaggagatggtgaccaaccacatgaagggcgagcacaagaagctcgcggaggccatcttcaagctgacctaccagaacaaggtcgtgcgcgtgcagcggccgacgccccgcgggaccgtcatggacatcatctcccgccgggaccagcgcggcagcggccaggtggggacctacggcctgaacaccttcaccaacatggaggcccagctcatccggcagatggagggggagggcatcttcaagtccatccagcacctgacggtgaccgaggagatcgccgtccagaactggctggcccgcgtgggccgggagcgcctcagccggatggcgatctccggggacgactgcgtggtcaagcccctggacgaccgcttcgccagcgccctgaccgccctcaacgacatgggcaaggtgcggaaggacatccagcagtgggagccctcccgcgggtggaacgactggacccaggtgccgttctgcagccaccacttccacgagctggtcatgaaggacggccgggtgctggtggtcccctgccgcaaccaggacgagctcatcgggcgggcccgcatctcccagggcgcgggctggagcctgaaggagacggcctgcctggggaagtcctacgcccagatgtggaccctcatgtacttccaccggcgcgacctgcggctggccgccaacgcgatctgcagcgccgtgccctcccactgggtgcccaccagccgcaccacctggtccatccacgccaagcacgagtggatgacgaccgaggacatgctcgccgtctggaaccgggtgtggatccaggagaacccgtggatggaggacaagacccccgtggagagctgggaggaggtcccctacctgggcaagcgcgaggaccagtggtgcgggagcctgatcggcctcacctcccgcgcgacgtgggccaagaacatccagaccgccatcaaccaggtgcggagcctgatcgggaacgaggagtacaccgactacatgccctccatgaagcgcttccggcgcgaggaggaggaggccggcgtgctgtggtga

SEQ ID NO: 9380 - RNA, 9876 nt, synthetic construct
  misc_feature 1..9876: note = derived and/or modified CDS sequence (opt1) from DENV-2__EU482574__SS-prME
  source 1..9876: mol_type = other RNA
accgccggcgtgatcatcatgctgatccccaccgccatggcgttccacctcaccacccggaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgctgcccgagaacctcgagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctggacttcaacgagatggtgctcctgcacatggaggacaaggcctggctggtccaccggcagtggttcctcgacctgcccctgccctggctcccgggggccgacacccagggcagcaactggatccagaaggagacgctggtgaccttcaagaacccccacgcgaagaagcaggacgtggtcgtgctggggtcccaggagggcgccatgcacaccgccctcaccggggccacggagatccagatgagcagcggcaacctgctgttcaccggccacctcaagtgccgcctgcggatggacaagctgcagctcaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctggggcgcctcatcaccgtgaacccgatcgtgaccgagaaggacagccccgtcaacatcgaggcggagccgcccttcggcgactcctacatcatcatcggggtggagccgggccagctgaagctgaactggttcaagaaggggagctccatcggccagatgttcgagaccacgatgcgcggcgccaagcggatggccatcctcggggacaccgcctgggacttcggcagcctcggcggggtgttcacctccatcgggaaggccctgcaccaggtcttcggggcgatctacggcgccgccttcagcggggtgtcctggaccatgaagatcctgatcggcgtgatcatcacgtggatcgggatgaacagccgctccaccagcctctccgtcagcctggtgctggtgggcgtcgtgaccctctacctgggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctcgcctccgccatccagaaggcccacgaggagggcatctgcgggatccggagcgtcacccgcctggagaacctgatgtggaagcagatcacccccgagctcaaccacatcctgtccgagaacgaggtgaagctgacgatcatgaccggcgacatcaaggggatcatgcaggccggcaagcggagcctccgcccgcagcccaccgagctgaagtactcctggaagacctggggcaaggcgaagatgctgagcacggagtcccacaaccagaccttcctcatcgacgggcccgagaccgccgagtgcccgaacaccaaccgggcctggaacagcctggaggtggaggactacggcttcggggtcttcacgaccaacatctggctgaagctccgcgagaagcaggacgtgttctgcgactccaagctgatgagcgccgccatcaaggacaaccgggcggtgcacgccgacatgggctactggatcgagtccgccctgaacgacacctggaagatggagaaggccagcttcatcgaggtcaagtcctgccactggcccaagagccacaccctctggtccaacggcgtgctggagagcgagatgatcatccccaagaacttcgccgggcccgtgtcccagcacaactaccgcccgggctaccacacccagacggcggggccctggcacctgggcaagctcgagatggacttcgacttctgcgaggggaccaccgtcgtggtgaccgaggactgcggcaaccggggccccagcctgcgcacgaccaccgccagcgggaagctgatcaccgagtggtgctgccggtcctgcacgctgccgcccctgcgctaccggggcgaggacgggtgctggtacggcatggagatccgccccctgaaggagaaggaggagaacctcgtcaacagcctggtgaccgccgggcacggccagatcgacaacttctccctgggcgtgctcgggatggccctgttcctggaggagatgctccggacccgcgtcggcaccaagcacgcgatcctgctggtggccgtgagcttcgtcacgctcatcaccgggaacatgtccttccgggacctgggccgcgtgatggtgatggtcggggccaccatgaccgacgacatcggcatgggcgtgacgtacctggccctcctggccgcgttcaaggtgcgccccaccttcgccgccgggctgctcctgcggaagctgaccagcaaggagctcatgatggccaccatcggcatcgccctgctgtcccagagcacgatccccgagaccatcctcgagctgaccgacgcgctggccctcgggatgatggtcctgaagatcgtgcgcaacatggagaagtaccagctggccgtgaccatcatggccatctcctgcgtccccaacgccgtgatcctccagaacgcgtggaaggtgagctgcacgatcctggccgccgtctccgtgagccccctgctcctgacctccagccagcagaaggccgactggatccccctggcgctcaccatcaagggcctgaaccccaccgccatcttcctgacgaccctctcccggaccagcaagaagcgctcctggccgctgaacgaggccatcatggccgtcggcatggtgagcatcctggcctccagcctcctgaagaacgacatccccatgaccgggcccctggtggcgggcgggctcctgacggtctgctacgtgctgaccggccggagcgccgacctcgagctggagcgcgccgccgacgtgaagtgggaggaccaggccgagatctccgggagctcccccatcctgagcatcaccatctccgaggacggcagcatgtccatcaagaacgaggaggaggagcagaccctcacgatcctgatccggaccggcctgctcgtcatcagcggggtgttcccggtgtccatccccatcaccgcggccgcctggtacctgtgggaggtcaagaagcagcgcgccggcgtgctgtgggacgtgccctccccgccgcccgtcgggaaggccgagctcgaggacggcgcgtaccggatcaagcagcgcgggatcctgggctactcccagatcggcgccggggtgtacaaggagggcaccttccacaccatgtggcacgtgacgcgcggggccgtcctgatgcaccgcggcaagcggatcgagcccagctgggccgacgtgaagaaggacctcatctcctacgggggcggctggaagctggagggggagtggaaggagggcgaggaggtgcaggtcctggccctcgagcccgggaagaacccccgcgcggtgcagaccaagcccggcctgttcaagaccaacaccgggacgatcggcgccgtgagcctggacttctcccccggcaccagcgggtcccccatcgtcgaccggaagggcaaggtggtggggctctacggcaacggcgtcgtgacccgcagcggggcctacgtgtccgccatcgcgcagaccgagaagtccatcgaggacaaccccgagatcgaggacgacatcttccggaagaagcgcctgacgatcatggacctgcaccccggcgccgggaagaccaagcggtacctgcccgccatcgtccgcgaggccatcaagcggggcctccgcaccctgatcctggccccgacccgcgtggtggcggccgagatggaggaggccctccgggggctgcccatccgctaccagacgcccgccatccgggccgagcacaccggccgcgagatcgtcgacctgatgtgccacgcgaccttcaccatgcggctcctgagccccgtgcgcgtgccgaactacaacctgatcatcatggacgaggcccacttcacggaccccgcctccatcgccgcccggggctacatcagcacccgcgtcgagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtgtggttcgtcccgtccatcaaggcgggcaacgacatcgccgcctgcctccgcaagaacggcaagaaggtgatccagctgagccggaagaccttcgactccgagtacgtgaagacccgcgccaacgactgggacttcgtcgtgacgaccgacatcagcgagatgggggccaacttcaaggcggagcgggtgatcgacccccgccggtgcatgaagcccgtcatcctgaccgacggcgaggagcgcgtgatcctcgccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacgcccgagggcatcatcccgtccatgttcgagcccgagcgcgagaaggtcgacgccatcgacggggagtaccggctgcgcggcgaggcccggaagaccttcgtggacctgatgcgccgcggggacctccccgtgtggctggcctaccgcgtcgccgcggagggcatcaactacgccgaccggcgctggtgcttcgacgggatcaagaacaaccagatcctggaggagaacgtggaggtggagatctggaccaaggagggcgagcggaagaagctcaagccgcgctggctggacgcccggatctacagcgaccccctggccctcaaggagttcaaggagttcgcggccggccgcaagtccctgaccctgaacctcatcacggagatggggcggctgcccaccttcatgacccagaaggcccgcgacgccctggacaacctcgccgtcctgcacaccgcggaggccggcgggcgggcctacaaccacgccctgagcgagctccccgagacgctggagaccctgctcctgctgaccctcctggccaccgtgacgggcggcatcttcctgttcctcatgtccgggaagggcatcgggaagatgaccctgggcatgtgctgcatcatcaccgcgagcatcctgctctggtacgcccagatccagccgcactggatcgccgcctccatcatcctggagttcttcctgatcgtcctcctgatccccgagcccgagaagcagcgcacgccccaggacaaccagctgacctacgtggtgatcgccatcctcacggtcgtggcggccaccatggccaacgagatggggttcctggagaagaccaagaaggacctgggcctcggcagcatcaccacgcaggagagcgagtccaacatcctggacatcgacctgcggccggccagcgcctggaccctctacgcggtggccaccaccttcgtcacgcccatgctgcgccactccatcgagaacagctccgtgaacgtgagcctgaccgccatcgccaaccaggcgaccgtcctcatggggctgggcaaggggtggcccctgtccaagatggacatcggcgtgcccctcctggccatcgggtgctacagccaggtgaacccgatcaccctgacggccgccctcctgctgctcgtcgcccactacgcgatcatcggccccggcctgcaggccaaggccacccgggaggcccagaagcgcgccgcggccgggatcatgaagaaccccaccgtggacggcatcaccgtgatcgacctggagcccatcccgtacgaccccaagttcgagaagcagctcgggcaggtcatgctgctgatcctctgcgtgacccaggtgctgatgatgcgcaccacctgggccctgtgcgaggccctcaccctggccacgggccccatctccaccctgtgggaggggaaccccggccggttctggaacaccaccatcgcggtcagcatggccaacatcttccgcggctcctacctcgccggggccggcctgctgttcagcatcatgaagaacacgaccaacacccggcgcgggaccggcaacatcggcgagacgctcggggagaagtggaagtcccggctgaacgcgctgggcaagagcgagttccagatctacaagaagtccgggatccaggaggtggaccgcaccctcgccaaggagggcatcaagcgcggggagaccgaccaccacgccgtgagccgcggctccgccaagctgcggtggttcgtcgagcgcaacatggtgaccccggagggcaaggtggtcgacctggggtgcggccgcgggggctggagctactactgcgggggcctcaagaacgtgcgcgaggtgaagggcctgacgaagggcggccccgggcacgaggagcccatccccatgtccacctacggctggaacctggtccggctccagagcggggtggacgtgttcttcaccccgcccgagaagtgcgacaccctgctgtgcgacatcggcgagagctcccccaaccccacgatcgaggccggccgcaccctccgggtcctgaacctggtggagaactggctcaacaacaacacccagttctgcatcaaggtgctgaacccgtacatgcccagcgtcatcgagaagatggagaccctgcagcgcaagtacgggggcgcgctggtgcggaaccccctctcccgcaacagcacccacgagatgtactgggtgtccaacgccacggggaacatcgtcagctccgtgaacatgatcagccggatgctgatcaaccgcttcaccatgaagcacaagaaggccacctacgagccggacgtggacctgggctccgggacccgcaacatcggcatcgagagcgagatccccaacctcgacatcatcggcaagcggatcgagaagatcaagcaggagcacgagacgtcctggcactacgaccaggaccacccctacaagacctgggcctaccacgggagctacgagaccaagcagaccggctccgccagctccatggtcaacggggtggtgcgcctgctgacgaagccctgggacgtcgtgccgatggtgacccagatggcgatgaccgacaccacgcccttcggccagcagcgggtcttcaaggagaaggtggacacccgcacccaggagcccaaggagggcaccaagaagctcatgaagatcacggccgagtggctgtggaaggagctggggaagaagaagacgccccggatgtgcacccgcgaggagttcacccggaaggtgcgcagcaacgccgccctcggcgccatcttcacggacgagaacaagtggaagtccgcgcgggaggccgtcgaggacagccgcttctgggagctgatcgaccgggagcgcaacctgcacctcgaggggaagtgcgagacctgcgtgtacaacatgatgggcaagcgggagaagaagctgggggagttcggcaaggccaagggctcccgcgccatctggtacatgtggctgggggcgcggttcctcgagttcgaggccctgggcttcctgaacgaggaccactggttcagccgcgggaacagcctctccggcgtggagggggagggcctgcaccggctgggctacatcctccgcgacgtcagcaagaaggagggcggcgccatgtacgccgacgacaccgccgggtgggacacccggatcacgctggaggacctgaagaacgaggagatggtgaccaaccacatgaagggcgagcacaagaagctcgcggaggccatcttcaagctgacctaccagaacaaggtcgtgcgcgtgcagcggccgacgccccgcgggaccgtcatggacatcatctcccgccgggaccagcgcggcagcggccaggtggggacctacggcctgaacaccttcaccaacatggaggcccagctcatccggcagatggagggggagggcatcttcaagtccatccagcacctgacggtgaccgaggagatcgccgtccagaactggctggcccgcgtgggccgggagcgcctcagccggatggcgatctccggggacgactgcgtggtcaagcccctggacgaccgcttcgccagcgccctgaccgccctcaacgacatgggcaaggtgcggaaggacatccagcagtgggagccctcccgcgggtggaacgactggacccaggtgccgttctgcagccaccacttccacgagctggtcatgaaggacggccgggtgctggtggtcccctgccgcaaccaggacgagctcatcgggcgggcccgcatctcccagggcgcgggctggagcctgaaggagacggcctgcctggggaagtcctacgcccagatgtggaccctcatgtacttccaccggcgcgacctgcggctggccgccaacgcgatctgcagcgccgtgccctcccactgggtgcccaccagccgcaccacctggtccatccacgccaagcacgagtggatgacgaccgaggacatgctcgccgtctggaaccgggtgtggatccaggagaacccgtggatggaggacaagacccccgtggagagctgggaggaggtcccctacctgggcaagcgcgaggaccagtggtgcgggagcctgatcggcctcacctcccgcgcgacgtgggccaagaacatccagaccgccatcaaccaggtgcggagcctgatcgggaacgaggagtacaccgactacatgccctccatgaagcgcttccggcgcgaggaggaggaggccggcgtgctgtggtga

SEQ ID NO: 9381 - RNA, 9876 nt, synthetic construct
  misc_feature 1..9876: note = derived and/or modified CDS sequence (opt1) from DENV-2__EU482575__SS-prME
  source 1..9876: mol_type = other RNA
accgccggcgtgatcatcatgctgatccccaccgccatggcgttccacctcaccacccgcaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcggcgccgggagaagcgctccgtcgccctggtgccccacgtggggatgggcctcgagacccggaccgagacctggatgagcagcgagggggcctggaagcacgtccagcgcatcgagacgtggatcctgcggcacccgggcttcaccatcatggccgcgatcctggcctacaccatcgggaccacgcacttccagcgcgccctcatcttcatcctgctgaccgccgtggcgcccagcatgaccatgcggtgcatcggcatctccaaccgcgacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccggaagtactgcatcgaggccaagctgacgaacaccaccaccgagtcccgctgcccgacgcagggcgagcccagcctgaacgaggagcaggacaagcggttcctctgcaagcactccatggtggaccgcggctgggggaacggctgcgggctgttcggcaagggcgggatcgtgacctgcgcgatgttcacgtgcaagaagaacatggagggcaaggtcgtgctgcccgagaacctcgagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctggacttcaacgagatggtgctcctgcagatggaggacaaggcctggctggtccaccgccagtggttcctcgacctgcccctgccctggctcccgggggccgacacccagggcagcaactggatccagaaggagacgctggtgaccttcaagaacccccacgcgaagaagcaggacgtggtcgtgctggggtcccaggagggcgccatgcacaccgccctcaccggggccacggagatccagatgagcagcggcaacctgctgttcaccggccacctcaagtgccggctgcgcatggacaagctgcagctcaaggggatgtcctacagcatgtgcaccggcaagttcaagatcgtcaaggagatcgccgagacccagcacgggacgatcgtgatccgggtgcagtacgagggcgacggctccccctgcaagatccccttcgagatcatggacctggagaagcgccacgtcctggggcgcctcatcaccgtgaacccgatcgtgaccgagaaggacagccccgtcaacatcgaggcggagccgcccttcggcgactcctacatcatcatcggggtggagccgggccagctgaagctgaactggttcaagaaggggagctccatcggccagatgttcgagaccacgatgcggggcgccaagcgcatggccatcctcggggacaccgcctgggacttcggcagcctcggcggggtgttcacctccatcgggaaggccctgcaccaggtcttcggggcgatctacggcgccgccttcagcggggtgtcctggaccatgaagatcctgatcggcgtgatcatcacgtggatcgggatgaacagccggtccaccagcctctccgtcagcctggtgctggtgggcgtcgtgaccctctacctgggggccatggtgcaggcggactccggctgcgtcgtgagctggaagaacaaggagctgaagtgcggctccgggatcttcatcaccgacaacgtgcacacgtggaccgagcagtacaagttccagcccgagagccccagcaagctcgcctccgccatccagaaggcccacgaggagggcatctgcgggatccgcagcgtcacccggctggagaacctgatgtggaagcagatcacccccgagctcaaccacatcctgtccgagaacgaggtgaagctgacgatcatgaccggcgacatcaaggggatcatgcaggccggcaagcgcagcctccggccgcagcccaccgagctgaagtactcctggaagacctggggcaaggcgaagatgctgagcacggagtcccacaaccagaccttcctcatcgacgggcccgagaccgccgagtgcccgaacaccaaccgcgcctggaacagcctggaggtggaggactacggcttcggggtcttctccacgaacatctggctgaagctccgggagaagcaggacgtgttctgcgacagcaagctgatgtccgccgccatcaaggacaaccgcgcggtgcacgccgacatgggctactggatcgagagcgccctgaacgacacctggaagatggagaaggcctccttcatcgaggtcaagagctgccactggcccaagtcccacaccctctggagcaacggcgtgctggagtccgagatgatcatccccaagaacttcgccgggcccgtgagccagcacaactaccggccgggctaccacacccagaccgcggggccctggcacctgggcaagctcgagatggacttcgacttctgcgaggggacgaccgtcgtggtgaccgaggactgcggcaaccgcggccccagcctgcggaccacgaccgcctccgggaagctgatcaccgagtggtgctgccgcagctgcaccctgccgcccctgcggtaccgcggcgaggacgggtgctggtacggcatggagatccggcccctgaaggagaaggaggagaacctcgtcaactccctggtgacggccgggcacggccagatcgacaacttcagcctgggcgtgctcgggatggccctgttcctggaggagatgctccgcacccgggtcggcaccaagcacgcgatcctgctggtggccgtgtccttcgtcaccctcatcacggggaacatgagcttccgcgacctgggccgcgtgatggtgatggtcggggccaccatgaccgacgacatcggcatgggcgtgacctacctggccctcctggccgcgttcaaggtgcggcccacgttcgccgccgggctgctcctgcgcaagctgacctccaaggagctcatgatggccaccatcggcatcgccctgctgagccagtccaccatccccgagacgatcctcgagctgaccgacgcgctggccctcgggatgatggtcctgaagatcgtgcggaacatggagaagtaccagctggccgtgaccatcatggccatcagctgcgtccccaacgccgtgatcctccagaacgcgtggaaggtgtcctgcaccatcctggccgccgtcagcgtgagccccctgctcctgacgagctcccagcagaaggccgactggatccccctggcgctcaccatcaagggcctgaaccccaccgccatcttcctgaccacgctcagccgcacctccaagaagcggagctggccgctgaacgaggccatcatggccgtcggcatggtgtccatcctggccagcagcctcctgaagaacgacatccccatgaccgggcccctggtggcgggcgggctcctgaccgtctgctacgtgctgacgggccgctccgccgacctcgagctggagcgggccgccgacgtgaagtgggaggaccaggccgagatcagcgggtccagccccatcctgtccatcaccatcagcgaggacggctccatgagcatcaagaacgaggaggaggagcagaccctcaccatcctgatccgcacgggcctgctcgtcatctccggggtgttcccggtgagcatccccatcaccgcggccgcctggtacctgtgggaggtcaagaagcagcgggccggcgtgctgtgggacgtgcccagcccgccgcccgtcgggaaggccgagctcgaggacggcgcgtaccgcatcaagcagcgggggatcctgggctacagccagatcggcgccggggtgtacaaggagggcaccttccacaccatgtggcacgtgacccgcggggccgtcctgatgcaccggggcaagcgcatcgagccctcctgggccgacgtgaagaaggacctcatcagctacgggggcggctggaagctggagggggagtggaaggagggcgaggaggtgcaggtcctggccctcgagcccgggaagaacccccgggcggtgcagacgaagcccggcctgttcaagaccaacaccgggaccatcggcgccgtgtccctggacttcagccccggcacgtccgggagccccatcgtcgaccgcaagggcaaggtggtggggctctacggcaacggcgtcgtgacccggtccggggcctacgtgagcgccatcgcgcagaccgagaagtccatcgaggacaaccccgagatcgaggacgacatcttccgcaagaagcggctgaccatcatggacctgcaccccggcgccgggaagacgaagcgctacctgcccgccatcgtccgggaggccatcaagcgcggcctccgcaccctgatcctggccccgacccgggtggtggcggccgagatggaggaggccctccgcgggctgcccatccggtaccagacccccgccatccgcgccgagcacacgggccgggagatcgtcgacctgatgtgccacgcgaccttcaccatgcgcctcctgtcccccgtgcgggtgccgaactacaacctgatcatcatggacgaggcccacttcaccgaccccgccagcatcgccgcccgcggctacatctccacgcgggtcgagatgggggaggcggccggcatcttcatgaccgccacgccgcccgggagccgcgacccgttcccccagtccaacgcccccatcatggacgaggagcgggagatccccgagcgcagctggaactccggccacgagtgggtgaccgacttcaaggggaagacggtgtggttcgtcccgagcatcaaggcgggcaacgacatcgccgcctgcctccggaagaacggcaagaaggtgatccagctgtcccgcaagaccttcgacagcgagtacgtgaagacccgggccaacgactgggacttcgtcgtgaccacggacatctccgagatgggggccaacttcaaggcggagcgcgtgatcgacccccggcgctgcatgaagcccgtcatcctgaccgacggcgaggagcgggtgatcctcgccgggcccatgccggtgacccacagctccgccgcccagcgccgcggccggatcgggcgcaaccccaagaacgagaacgaccagtacatctacatgggcgagcccctggagaacgacgaggactgcgcccactggaaggaggcgaagatgctgctcgacaacatcaacacccccgagggcatcatcccgagcatgttcgagcccgagcgggagaaggtcgacgccatcgacggggagtaccgcctgcggggcgaggcccgcaagacgttcgtggacctgatgcggcgcggggacctccccgtgtggctggcctaccgggtcgccgcggagggcatcaactacgccgaccgccggtggtgcttcgacgggatcaagaacaaccagatcctggaggagaacgtggaggtggagatctggaccaaggagggcgagcgcaagaagctcaagccgcggtggctggacgcccgcatctactccgaccccctggccctcaaggagttcaaggagttcgcggccggccgcaagagcctgaccctgaacctcatcaccgagatggggcggctgcccacgttcatgacccagaaggcccgggacgccctggacaacctcgccgtcctgcacaccgcggaggccggcgggcgcgcctacaaccacgccctgtccgagctccccgagaccctggagacgctgctcctgctgaccctcctggccaccgtgaccggcggcatcttcctgttcctcatgagcgggaagggcatcgggaagatgacgctgggcatgtgctgcatcatcaccgcgtccatcctgctctggtacgcccagatccagccgcactggatcgccgccagcatcatcctggagttcttcctgatcgtcctcctgatccccgagcccgagaagcagcggacgccccaggacaaccagctgacctacgtggtgatcgccatcctcaccgtcgtggcggccacgatggccaacgagatggggttcctggagaagaccaagaaggacctgggcctcggcagcatcaccacccaggagtccgagagcaacatcctggacatcgacctgcgcccggcctccgcctggacgctctacgcggtggccaccaccttcgtcacccccatgctgcggcacagcatcgagaactccagcgtgaacgtgtccctgacggccatcgccaaccaggcgaccgtcctcatggggctgggcaaggggtggcccctgagcaagatggacatcggcgtgcccctcctggccatcgggtgctactcccaggtgaacccgatcaccctgaccgccgccctcctgctgctcgtcgcccactacgcgatcatcggccccggcctgcaggccaaggccacgcgcgaggcccagaagcgcgccgcggccgggatcatgaagaaccccaccgtggacggcatcaccgtgatcgacctggagcccatcccgtacgaccccaagttcgagaagcagctcgggcaggtcatgctgctgatcctctgcgtgacccaggtgctgatgatgcggacgacctgggccctgtgcgaggccctcaccctggccaccggccccatcagcacgctgtgggaggggaaccccggccgcttctggaacaccaccatcgcggtctccatggccaacatcttccggggcagctacctcgccggggccggcctgctgttctccatcatgaagaacaccacgaacacccgccgggggaccggcaacatcggcgagaccctcggggagaagtggaagtcccgcctgaacgcgctgggcaagtccgagttccagatctacaagaagtccgggatccaggaggtggaccggacgctcgccaaggagggcatcaagcgcggggagaccgaccaccacgccgtgtcccggggcagcgccaagctgcgctggttcgtcgagcggaacatggtgaccccggagggcaaggtggtcgacctggggtgcggccgcgggggctggtcctactactgcgggggcctcaagaacgtgcgggaggtgaagggcctgaccaagggcgggcccgggcacgaggagcccatccccatgagcacgtacggctggaacctggtccgcctccagagcggggtggacgtgttcttcaccccgcccgagaagtgcgacaccctgctgtgcgacatcggcgagtccagccccaaccccaccatcgaggccggccggacgctccgcgtcctgaacctggtggagaactggctcaacaacaacacccagttctgcatcaaggtgctgaacccgtacatgccctccgtcatcgagaagatggagaccctgcagcggaagtacgggggcgcgctggtgcgcaaccccctcagccggaactccacccacgagatgtactgggtgagcaacgccaccgggaacatcgtctccagcgtgaacatgatctcccgcatgctgatcaaccgcttcacgatgaagcacaagaaggccacctacgagccggacgtggacctgggcagcgggacccggaacatcggcatcgagtccgagatccccaacctcgacatcatcggcaagcgcatcgagaagatcaagcaggagcacgagaccagctggcactacgaccaggaccacccctacaagacgtgggcctaccacgggtcctacgagaccaagcagaccggcagcgcctccagcatggtcaacggggtggtgcggctgctgaccaagccctgggacgtcgtgccgatggtgacgcagatggcgatgaccgacaccacccccttcggccagcagcgcgtcttcaaggagaaggtggacacgcggacccaggagcccaaggagggcaccaagaagctcatgaagatcaccgccgagtggctgtggaaggagctggggaagaagaagacgccccgcatgtgcacccgggaggagttcacccgcaaggtgcggtccaacgccgccctcggcgccatcttcaccgacgagaacaagtggaagtccgcgcgcgaggccgtcgaggactcccggttctgggagctgatcgaccgcgagcggaacctgcacctcgaggggaagtgcgagacgtgcgtgtacaacatgatgggcaagcgcgagaagaagctgggggagttcggcaaggccaagggcagccgggccatctggtacatgtggctgggggcgcgcttcctcgagttcgaggccctgggcttcctgaacgaggaccactggttcagccgggggaactccctcagcggcgtggagggggagggcctgcaccgcctgggctacatcctccgggacgtctccaagaaggagggcggcgccatgtacgccgacgacaccgccgggtgggacacccgcatcaccctggaggacctgaagaacgaggagatggtgacgaaccacatgaagggcgagcacaagaagctcgcggaggccatcttcaagctgacctaccagaacaaggtcgtgcgggtgcagcgcccgacgccccgcgggaccgtcatggacatcatcagccggcgcgaccagcggggctccggccaggtggggacctacggcctgaacaccttcaccaacatggaggcccagctcatccgccagatggagggggagggcatcttcaagagcatccagcacctgaccgtgacggaggagatcgccgtccagaactggctggcccgggtgggccgcgagcggctctcccgcatggcgatcagcggggacgactgcgtggtcaagcccctggacgaccggttcgcctccgccctgaccgccctcaacgacatgggcaaggtgcgcaaggacatccagcagtgggagcccagccgggggtggaacgactggacccaggtgccgttctgctcccaccacttccacgagctggtcatgaaggacggccgcgtgctggtggtcccctgccggaaccaggacgagctcatcgggcgcgcccggatcagccagggcgcgggctggtccctgaaggagaccgcctgcctgggcaagagctacgcccagatgtggacgctcatgtacttccaccgccgggacctgcgcctggccgccaacgcgatctgctccgccgtgcccagccactgggtgcccacctcccggaccacctggagcatccacgccaagcacgagtggatgaccacggaggacatgctcgccgtctggaaccgcgtgtggatccaggagaacccgtggatggaggacaagacccccgtggagagctgggaggaggtcccctacctgggcaagcgcgaggaccagtggtgcgggtccctgatcggcctcaccagccgggcgacctgggccaagaacatccagacggccatcaaccaggtgcgctccctgatcgggaacgaggagtacaccgactacatgcccagcatgaagcggttccgccgggaggaggaggaggccggcgtgctgtggtga

SEQ ID NO: 9382 - RNA, 9876 nt, synthetic construct
  misc_feature 1..9876: note = derived and/or modified CDS sequence (opt1) from DENV-2__EU482578__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagtccaaggagctgaagtgcggcagcgggatcttcatcaccgacaacgtccacacgtggaccgagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgacgatcatgaccggcgacatcaaggggatcatgcaggccggcaagcggtccctgcgcccgcagcccaccgagctcaagtacagctggaagacctggggcaaggcgaagatgctgtccacggagagccacaaccagaccttcctgatcgacgggcccgagaccgccgagtgcccgaacaccaaccgggcctggaactccctcgaggtcgaggactacggcttcggggtgttcacgaccaacatctggctgaagctgcgcgagaagcaggacgtgttctgcgacagcaagctcatgtccgccgccatcaaggacaaccgggcggtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagacggcggggccctggcacctgggcaagctggagatggacttcgacttctgcgaggggaccaccgtggtggtcaccgaggactgcggcaaccggggccccagcctccgcacgaccaccgcctccgggaagctgatcaccgagtggtgctgccggagctgcacgctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacccgcgtgggcaccaagcacgcgatcctcctggtggccgtctccttcgtgacgctgatcaccgggaacatgagcttccgggacctcggccgcgtgatggtcatggtgggggccaccatgaccgacgacatcggcatgggcgtgacgtacctggccctgctcgccgcgttcaaggtccgccccaccttcgccgccgggctgctgctccggaagctgacctccaaggagctgatgatggccaccatcggcatcgccctcctgagccagtccacgatccccgagaccatcctggagctcaccgacgcgctggccctggggatgatggtgctcaagatcgtgcgcaacatggagaagtaccagctggccgtcaccatcatggccatcagctgcgtgccgaacgccgtgatcctgcagaacgcgtggaaggtctcctgcacgatcctcgccgccgtgagcgtcagccccctgctgctcaccagctcccagcagaaggccgactggatccccctggcgctgaccatcaagggcctcaaccccaccgccatcttcctgacgaccctgagccggacctccaagaagcgcagctggccgctcaacgaggccatcatggccgtgggcatggtgtccatcctggccagcagcctgctcaagaacgacatccccatgaccgggcccctggtcgcgggcgggctgctcacggtgtgctacgtgctgaccggccggtccgccgacctggagctcgagcgcgccgccgacgtcaagtgggaggaccaggccgagatcagcgggtccagccccatcctgtccatcaccatcagcgaggacggctccatgagcatcaagaacgaggaggaggagcagaccctgacgatcctcatccggaccggcctgctggtgatctccggggtgttcccggtcagcatccccatcaccgcggccgcctggtacctctgggaggtgaagaagcagcgcgccggcgtgctgtgggacgtccccagcccgccgcccgtggggaaggccgagctggaggacggcgcgtaccggatcaagcagcgcgggatcctcggctacagccagatcggcgccggggtgtacaaggagggcaccttccacaccatgtggcacgtcacgcgcggggccgtgctgatgcaccgcggcaagcggatcgagccctcctgggccgacgtgaagaaggacctgatcagctacgggggcggctggaagctcgagggggagtggaaggagggcgaggaggtccaggtgctggccctggagcccgggaagaacccccgcgcggtgcagaccaagcccggcctcttcaagaccaacaccgggacgatcggcgccgtctccctggacttcagccccggcacctccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcacgatcatggacctgcaccccggcgccgggaagaccaagcggtacctgcccgccatcgtgcgcgaggccatcaagcggggcctgcgcaccctcatcctggccccgacccgcgtggtcgcggccgagatggaggaggccctgcgggggctccccatccgctaccagacgcccgccatccgggccgagcacaccggccgcgagatcgtggacctgatgtgccacgcgaccttcaccatgcggctgctctcccccgtgcgcgtcccgaactacaacctgatcatcatggacgaggcccacttcacggaccccgccagcatcgccgcccggggctacatctccacccgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgacggacttcaaggggaagaccgtctggttcgtgccgagcatcaaggcgggcaacgacatcgccgcctgcctgcgcaagaacggcaagaaggtgatccagctctcccggaagaccttcgacagcgagtacgtcaagacccgcgccaacgactgggacttcgtggtgacgaccgacatctccgagatgggggccaacttcaaggcggagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacgcccgagggcatcatcccgagcatgttcgagcccgagcgcgagaaggtggacgccatcgacggggagtaccggctccgcggcgaggcccggaagaccttcgtggacctgatgcgccgcggggacctgcccgtctggctcgcctaccgcgtggccgcggagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcaccctgaacctgatcacggagatggggcggctccccaccttcatgacccagaaggcccgcgacgccctggacaacctggccgtgctccacaccgcggaggccggcgggcgggcctacaaccacgccctgtccgagctgcccgagacgctcgagaccctgctgctcctgaccctgctcgccaccgtcacgggcggcatcttcctgttcctgatgagcgggaagggcatcgggaagatgaccctcggcatgtgctgcatcatcaccgcgtccatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgccatcctgacggtggtggcggccaccatggccaacgagatggggttcctcgagaagaccaagaaggacctgggcctgggcagcatcaccacgcaggagtccgagagcaacatcctcgacatcgacctgcggccggcctccgcctggaccctgtacgcggtcgccaccaccttcgtgacgcccatgctccgccacagcatcgagaactccagcgtgaacgtctccctgaccgccatcgccaaccaggcgaccgtgctgatggggctcggcaaggggtggcccctgagcaagatggacatcggcgtgcccctgctcgccatcgggtgctactcccaggtcaacccgatcaccctgacggccgccctgctcctgctggtggcccactacgcgatcatcggccccggcctccaggccaaggccacccgggaggcccagaagcgcgccgcggccgggatcatgaagaaccccaccgtggacggcatcaccgtcatcgacctggagcccatcccgtacgaccccaagttcgagaagcagctggggcaggtcatgctcctgatcctgtgcgtgacgcaggtcctcatgatgcgcaccacctgggccctgtgcgaggccctgaccctcgccacgggccccatcagcaccctgtgggaggggaaccccggccggttctggaacaccaccatcgcggtgtccatggccaacatcttccgcggcagctacctggccggggccggcctcctgttctccatcatgaagaacacgaccaacacccggcgcgggaccggcaacatcggcgagacgctgggggagaagtggaagtcccggctcaacgcgctgggcaagtccgagttccagatctacaagaagtccgggatccaggaggtggaccgcaccctggccaaggagggcatcaagcgcggggagaccgaccaccacgccgtctcccgcggcagcgccaagctccggtggttcgtggagcgcaacatggtgaccccggagggcaaggtcgtggacctggggtgcggccgcggcgggtggtcctactactgcggcgggctgaagaacgtgcgcgaggtcaaggggctcacgaagggcgggcccgggcacgaggagcccatccccatgagcacctacggctggaacctggtgcggctgcagagcggggtggacgtcttcttcaccccgcccgagaagtgcgacaccctcctgtgcgacatcggcgagtccagccccaaccccacgatcgaggccggccgcaccctgcgggtgctcaacctggtggagaactggctgaacaacaacacccagttctgcatcaaggtcctcaacccgtacatgccctccgtgatcgagaagatggagaccctgcagcgcaagtacgggggcgcgctggtgcggaaccccctgagccgcaactccacccacgagatgtactgggtcagcaacgccacggggaacatcgtgtccagcgtgaacatgatctcccggatgctcatcaaccgcttcaccatgaagcacaagaaggccacctacgagccggacgtcgacctgggcagcgggacccgcaacatcggcatcgagtccgagatccccaacctggacatcatcggcaagcggatcgagaagatcaagcaggagcacgagacgagctggcactacgaccaggaccacccctacaagacctgggcctaccacgggtcctacgagaccaagcagaccggcagcgcctccagcatggtgaacggggtggtccgcctcctgacgaagccctgggacgtggtgccgatggtcacccagatggcgatgaccgacaccacgcccttcggccagcagcgggtgttcaaggagaaggtggacacccgcacccaggagcccaaggagggcaccaagaagctgatgaagatcacggccgagtggctctggaaggagctggggaagaagaagacgccccggatgtgcacccgcgaggagttcacccggaaggtccgctccaacgccgccctgggcgccatcttcacggacgagaacaagtggaagtccgcgcgggaggccgtggaggactcccgcttctgggagctcatcgaccgggagcgcaacctgcacctggaggggaagtgcgagacctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttcagccgcgggaactccctgagcggcgtcgagggggagggcctccaccggctgggctacatcctgcgcgacgtgtccaagaaggagggcggggccatgtacgccgacgacaccgccgggtgggacacccggatcacgctcgaggacctgaagaacgaggagatggtcaccaaccacatgaagggcgagcacaagaagctggcggaggccatcttcaagctcacctaccagaacaaggtggtgcgcgtccagcggccgacgccccgggggacggtgatggacatcatcagccgccgggaccagcgcggctccggccaggtggggacctacggcctgaacaccttcaccaacatggaggcccagctgatccggcagatggagggggagggcatcttcaagagcatccagcacctcacggtcaccgaggagatcgccgtgcagaactggctggcccgcgtgggccgggagcgcctgtcccggatggcgatcagcggggacgactgcgtcgtgaagcccctcgacgaccgcttcgcctccgccctgaccgccctgaacgacatgggcaaggtgcggaaggacatccagcagtgggagcccagccgcgggtggaacgactggacccaggtcccgttctgctcccaccacttccacgagctcgtgatgaaggacggccgggtgctggtcgtgccctgccgcaaccaggacgagctgatcgggcgggcccgcatcagccagggcgcgggctggtccctcaaggagacggcctgcctgggcaagagctacgcccagatgtggaccctgatgtacttccaccggcgcgacctccggctggccgccaacgcgatctgctccgccgtgcccagccactgggtccccacctcccgcaccacctggagcatccacgccaagcacgagtggatgacgaccgaggacatgctggccgtgtggaaccgggtgtggatccaggagaacccgtggatggaggacaagacccccgtcgagagctgggaggaggtgccctacctcggcaagcgcgaggaccagtggtgcgggtccctgatcggcctgaccagccgcgcgacgtgggccaagaacatccagaccgccatcaaccaggtgcggtccctcatcgggaacgaggagtacaccgactacatgcccagcatgaagcgcttccggcgcgaggaggaggaggccggcgtcctgtggtga

SEQ ID NO: 9383 - RNA, 9876 nt, synthetic construct
  misc_feature 1..9876: note = derived and/or modified CDS sequence (opt1) from DENV-2__EU482580__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatggacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcctctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcttcatcggcgtgatcatcacgtggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcaccgacaacgtgcacacgtggaccgagcagtacaagttccagcccgagagccccagcaagctggcctccgccatccagaaggcccacgaggagggcatctgcgggatccggagcgtcacccgcctggagaacctcatgtggaagcagatcacccccgagctgaaccacatcctgtccgagaacgaggtgaagctcacgatcatgaccggcgacatcaaggggatcatgcaggccggcaagcggagcctgcgcccgcagcccaccgagctgaagtactcctggaagacctggggcaaggcgaagatgctcagcacggagtcccacaaccagaccttcctgatcgacgggcccgagaccgccgagtgcccgaacaccaaccgggcctggaacagcctggaggtggaggactacggcttcggggtcttcacgaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagaacttcgccgggcccgtgtcccagcacaactaccgcccgggctaccacacccagacggcggggccctggcacctcggcaagctggagatggacttcgacttctgcgaggggaccaccgtcgtggtgaccgaggactgcggcaaccggggccccagcctgcgcacgaccaccgccagcgggaagctcatcaccgagtggtgctgccggtcctgcacgctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacccgcgtcggcaccaagcacgcgatcctgctcgtggccgtgagcttcgtcacgctgatcaccgggaacatgtccttccgggacctgggccgcgtgatggtgatggtcggggccaccatgaccgacgacatcggcatgggcgtgacgtacctcgccctgctggccgcgttcaaggtgcgccccaccttcgccgccgggctcctgctgcggaagctcaccagcaaggagctgatgatggccaccatcggcatcgccctgctctcccagagcacgatccccgagaccatcctggagctgaccgacgcgctcgccctggggatgatggtcctgaagatcgtgcgcaacatggagaagtaccagctcgccgtgaccatcatggccatctcctgcgtcccgaacgccgtgatcctgcagaacgcgtggaaggtgagctgcacgatcctggccgccgtctccgtgagccccctcctgctgacctccagccagcagaaggccgactggatccccctcgcgctgaccatcaagggcctgaaccccaccgccatcttcctcacgaccctgtcccggaccagcaagaagcgctcctggccgctgaacgaggccatcatggccgtcggcatggtgagcatcctcgcctccagcctgctgaagaacgacatccccatgaccgggcccctcgtggcgggcgggctgctgacggtctgctacgtgctcaccggccggagcgccgacctggagctggagcgcgccgccgacgtgaagtgggaggaccaggccgagatctccgggagctcccccatcctcagcatcaccatctccgaggacggcagcatgtccatcaagaacgaggaggaggagcagaccctgacgatcctgatccggaccggcctcctggtcatcagcggggtgttcccggtgtccatccccatcaccgcggccgcctggtacctgtgggaggtcaagaagcagcgcgccggcgtgctctgggacgtgcccagcccgccgcccgtcgggaaggccgagctggaggacggcgcgtaccggatcaagcagcgcgggatcctgggctactcccagatcggcgccggggtgtacaaggagggcaccttccacaccatgtggcacgtgacgcgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgccctggagcccgggaagaacccccgcgcggtgcagaccaagcccggcctgttcaagaccaacaccgggacgatcggcgccgtgagcctcgacttctcccccggcaccagcgggtcccccatcgtcgaccggaagggcaaggtggtggggctgtacggcaacggcgtcgtgacccgcagcggggcctacgtgtccgccatcgcgcagaccgagaagtccatcgaggacaaccccgagatcgaggacgacatcttccggaagaagcgcctgacgatcatggacctccaccccggcgccgggaagaccaagcggtacctgcccgccatcgtccgcgaggccatcaagcggggcctgcgcaccctgatcctcgccccgacccgcgtggtggcggccgagatggaggaggccctgcgggggctgcccatccgctaccagacgcccgccatccgggccgagcacaccggccgcgagatcgtcgacctcatgtgccacgcgaccttcaccatgcggctgctgagccccgtgcgcgtgccgaactacaacctcatcatcatggacgaggcccacttcacggaccccgcctccatcgccgcccggggctacatcagcacccgcgtcgagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtgtggttcgtcccgtccatcaaggcgggcaacgacatcgccgcctgcctgcgcaagaacggcaagaaggtgatccagctgagccggaagaccttcgactccgagtacgtgaagacccgcgccaacgactgggacttcgtcgtgacgaccgacatcagcgagatgggggccaacttcaaggcggagcgggtgatcgacccccgccggtgcatgaagcccgtcatcctcaccgacggcgaggagcgcgtgatcctggccgggcccatgccggtgacccactccagcgccgcccagcggcgcggccgcatcgggcggaaccccaagaacgagaacgaccagtacatctacatgggcgagcccctggagaacgacgaggactgcgcccactggaaggaggcgaagatgctcctggacaacatcaacacgcccgagggcatcatcccgtccatgttcgagcccgagcgcgagaaggtcgacgccatcgacggggagtaccggctgcgcggcgaggcccggaagaccttcgtggacctcatgcgccgcggggacctgcccgtgtggctggcctaccgcgtcgccgcggagggcatcaactacgccgaccggcgctggtgcttcgacgggatcaagaacaaccagatcctcgaggagaacgtggaggtggagatctggaccaaggagggcgagcggaagaagctgaagccgcgctggctggacgcccggatctacagcgaccccctcgccctgaaggagttcaaggagttcgcggccggccgcaagtccctgaccctcaacctgatcacggagatggggcggctgcccaccttcatgacccagaaggcccgcgacgccctcgacaacctggccgtcctgcacaccgcggaggccggcgggaaggcctacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgcgagcatcctcctgtggtacgcccagatccagccgcactggatcgccgcctccatcatcctggagttcttcctcatcgtcctgctgatccccgagcccgagaagcagcggacgccccaggacaaccagctcacctacgtggtgatcgccatcctgacggtcgtggcggccaccatggccaacgagatggggttcctggagaagaccaagaaggacctcggcctgggcagcatcaccacgcaggagagcgagtccaacatcctggacatcgacctccgcccggccagcgcctggaccctgtacgcggtggccaccaccttcgtcacgcccatgctgcggcactccatcgagaacagctccgtgaacgtgagcctcaccgccatcgccaaccaggcgaccgtcctgatggggctgggcaaggggtggcccctctccaagatggacatcggcgtgcccctgctggccatcgggtgctacagccaggtgaacccgatcaccctcacggccgccctgctgctcctggtcgcccactacgcgatcatcggccccggcctgcaggccaaggccacccgcgaggcccagaagcgggccgcggccgggatcatgaagaaccccaccgtggacggcatcaccgtgatcgacctcgagcccatcccgtacgaccccaagttcgagaagcagctggggcaggtcatgctgctcatcctgtgcgtgacccaggtgctgatgatgcgcaccacctgggccctctgcgaggccctgaccctggccacgggccccatctccaccctctgggaggggaaccccggccgcttctggaacaccaccatcgcggtcagcatggccaacatcttccggggctcctacctggccggggccggcctcctgttcagcatcatgaagaacacgaccaacacccgccgggggaccggcaacatcggcgagacgctgggggagaagtggaagtcccgcctgaacgcgctcggcaagagcgagttccagatctacaagaagtccgggatccaggaggtggaccggaccctggccaaggagggcatcaagcgcggggagaccgaccaccacgccgtgagccggggctccgccaagctgcgctggttcgtcgagcggaacatggtgaccccggagggcaaggtggtcgacctcgggtgcggccgcgggggctggagctactactgcgggggcctgaagaacgtgcgggaggtgaagggcctgacgaagggcgggcccgggcacgaggagcccatccccatgtccacctacggctggaacctcgtccgcctgcagagcggggtggacgtgttcttcaccccgcccgagaagtgcgacaccctgctctgcgacatcggcgagagctcccccaaccccacgatcgaggccggccggaccctgcgcgtcctgaacctcgtggagaactggctgaacaacaacacccagttctgcatcaaggtgctgaacccgtacatgcccagcgtcatcgagaagatggagaccctccagcggaagtacgggggcgcgctggtgcgcaaccccctgtcccggaacagcacccacgagatgtactgggtgtccaacgccacggggaacatcgtcagctccgtgaacatgatcagccgcatgctgatcaaccggttcaccatgaagcacaagaaggccacctacgagccggacgtggacctcggctccgggacccgcaacatcggcatcgagagcgagatccccaacctggacatcatcggcaagcgcatcgagaagatcaagcaggagcacgagacgtcctggcactacgaccaggaccacccctacaagacctgggcctaccacgggagctacgagaccaagcagaccggctccgccagctccatggtcaacggggtggtgcggctgctcacgaagccctgggacgtcgtgccgatggtgacccagatggcgatgaccgacaccacgcccttcggccagcagcgcgtcttcaaggagaaggtggacacccggacccaggagcccaaggagggcaccaagaagctgatgaagatcacggccgagtggctgtggaaggagctcgggaagaagaagacgccccggatgtgcacccgggaggagttcacccgcaaggtgcggagcaacgccgccctgggcgccatcttcacggacgagaacaagtggaagtccgcgcgcgaggccgtcgaggacagccggttctgggagctggtggaccgcgagcggaacctccacctggaggggaagtgcgagacctgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtcgagggggagggcctgcaccgcctcggctacatcctgcgggacgtgagcaagaaggagggcggcgccatgtacgccgacgacaccgccgggtgggacacccgcatcacgctggaggacctcaagaacgaggagatggtcaccaaccacatgaagggcgagcacaagaagctggcggaggccatcttcaagctgacctaccagaacaaggtggtgcgggtccagcgcccgacgccccgggggacggtgatggacatcatctcccgccgcgaccagcggggcagcggccaggtggggacctacggcctcaacaccttcaccaacatggaggcccagctgatccgccagatggagggggagggcatcttcaagtccatccagcacctgacggtcaccgaggagatcgccgtgcagaactggctcgcccgggtgggccgcgagcggctgagccgcatggcgatctccggggacgactgcgtcgtgaagcccctggacgaccggttcgccagcgccctcaccgccctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcgggcgcgcccggatctcccagggcgcgggctggagcctgaaggagacggcctgcctcgggaagtcctacgcccagatgtggaccctgatgtacttccaccgccgggacctgcgcctcgccgccaacgcgatctgcagcgccgtgccctcccactgggtccccaccagccggaccacctggtccatccacgccaagcacgagtggatgacgaccgaggacatgctggccgtgtggaaccgcgtgtggatccaggagaacccgtggatggaggacaagacccccgtcgagagctgggaggaggtgccctacctgggcaagcgggaggaccagtggtgcgggagcctcatcggcctgacctcccgcgcgacgtgggccaagaacatccagaccgccatcaaccaggtgcgcagcctgatcgggaacgaggagtacaccgactacatgccctccatgaagcggttccgccgggaggaggaggaggccggcgtcctctggtga

SEQ ID NO: 9384 - RNA, 9876 nt, synthetic construct
  misc_feature 1..9876: note = derived and/or modified CDS sequence (opt1) from DENV-2__EU482581__SS-prME
  source 1..9876: mol_type = other RNA
accgcgggcgtcatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccggcaaggacagccccgtgaacatcgaggcggagccgcccttcggggactcctacatcatcatcggcgtggagccggggcagctcaagctgaactggttcaagaagggcagctccatcggccagatgttcgagaccacgatgcgcggggccaagcggatggccatcctgggcgacaccgcctgggacttcgggagcctcggcggggtcttcacctccatcggcaaggccctgcaccaggtgttcggcgcgatctacggggccgccttcagcggcgtgtcctggaccatgaagatcctgatcggggtcatcatcacgtggatcggcatgaacagccgctccaccagcctgtccgtgagcctcgtgctggtcggggtggtgaccctgtacctcggcgccatggtccaggcggactccggctgcgtggtgagctggaagtccaaggagctgaagtgcgggagcggcatcttcatcaccgacaacgtccacacgtggaccgagcagtacaagttccagcccgagagcccctccaagctggccagcgccatccagaaggcccacgaggaggggatctgcggcatccggtccgtgacccgcctcgagaacctgatgtggaagcagatcacccccgagctgaaccacatcctcagcgagaacgaggtgaagctgacgatcatgaccggggacatcaagggcatcatgcaggccggcaagcggtccctgcgcccgcagcccaccgagctcaagtacagctggaagacctgggggaaggcgaagatgctgtccacggagagccacaaccagaccttcctgatcgacggccccgagaccgccgagtgcccgaacaccaaccgggcctggaactccctcgaggtcgaggactacgggttcggcgtgttcacgaccaacatctggctgaagctgcgcgagaagcaggacgtgttctgcgacagcaagctcatgtccgccgccatcaaggacaaccgggcggtccacgccgacatgggctactggatcgagagcgccctgaacgacacctggaagatggagaaggcctccttcatcgaggtcaagagctgccactggcccaagtcccacaccctgtggagcaacggggtgctcgagtccgagatgatcatccccaagaacttcgccggccccgtgagccagcacaactaccgcccggggtaccacacccagacggcgggcccctggcacctggggaagctggagatggacttcgacttctgcgagggcaccaccgtggtggtcaccgaggactgcggcaaccgggggcccagcctccgcacgaccaccgcctccggcaagctgatcaccgagtggtgctgccggagctgcacgctgcccccgctccgctaccgcggggaggacggctgctggtacgggatggagatccgccccctgaaggagaaggaggagaacctggtgaactccctcgtgaccgccggccacggccagatcgacaacttcagcctgggggtcctgggcatggccctcttcctggaggagatgctgcggacccgcgtggggaccaagcacgcgatcctcctggtggccgtctccttcgtgacgctgatcaccggcaacatgagcttccgggacctcgggcgcgtgatggtcatggtgggcgccaccatgaccgacgacatcggcatgggggtgacgtacctggccctgctcgccgcgttcaaggtccgccccaccttcgccgccggcctgctgctccggaagctgacctccaaggagctgatgatggccaccatcgggatcgccctcctgagccagtccacgatccccgagaccatcctggagctcaccgacgcgctggccctgggcatgatggtgctcaagatcgtgcgcaacatggagaagtaccagctggccgtcaccatcatggccatcagctgcgtgccgaacgccgtgatcctgcagaacgcgtggaaggtctcctgcacgatcctcgccgccgtgagcgtcagccccctgctgctcaccagctcccagcagaaggccgactggatccccctggcgctgaccatcaagggcctcaaccccaccgccatcttcctgacgaccctgagccggacctccaagaagcgcagctggccgctcaacgaggccatcatggccgtggggatggtgtccatcctggccagcagcctgctcaagaacgacatccccatgaccggccccctggtcgccggcgggctgctcacggtgtgctacgtgctgaccgggcggtccgccgacctggagctcgagcgcgccgccgacgtcaagtgggaggaccaggccgagatcagcgggtccagccccatcctgtccatcaccatcagcgaggacggctccatgagcatcaagaacgaggaggaggagcagaccctgacgatcctcatccggaccgggctgctggtgatctccggcgtgttcccggtcagcatccccatcaccgcggccgcctggtacctctgggaggtgaagaagcagcgcgccggggtgctgtgggacgtccccagcccgccgcccgtgggcaaggccgagctggaggacggggcgtaccggatcaagcagcgcggcatcctcggctacagccagatcggggccggcgtgtacaaggaggggaccttccacaccatgtggcacgtcacgcggggcgccgtgctgatgcaccgcgggaagcggatcgagccctcctgggccgacgtgaagaaggacctgatcagctacggcggcgggtggaagctcgagggcgagtggaaggagggggaggaggtccaggtgctggccctggagcccggcaagaacccccgcgcggtgcagaccaagcccggcctcttcaagaccaacaccggcacgatcggcgccgtctccctggacttcagccccgggacctccggcagccccatcgtggaccggaaggggaaggtggtcggcctgtacggcaacggggtggtgacccgctccggcgcctacgtcagcgccatcgcgcagaccgagaagtccatcgaggacaaccccgagatcgaggacgacatcttccggaagaagcgcctcacgatcatggacctgcaccccggggccggcaagaccaagcggtacctgcccgccatcgtgcgcgaggccatcaagcgggggctgcgcaccctcatcctggccccgacccgcgtggtcgcggccgagatggaggaggccctgcggggcctccccatccgctaccagacgcccgccatccgggccgagcacaccggccgcgagatcgtggacctgatgtgccacgcgaccttcaccatgcggctgctctcccccgtgcgcgtcccgaactacaacctgatcatcatggacgaggcccacttcacggaccccgccagcatcgccgcccgggggtacatctccacccgcgtggagatgggcgaggcggccgggatcttcatgaccgccacgccgcccggcagccgggacccgttcccccagtccaacgcccccatcatggacgaggagcgcgagatccccgagcggagctggaactccgggcacgagtgggtgacggacttcaagggcaagaccgtctggttcgtgccgagcatcaaggcgggcaacgacatcgccgcctgcctgcgcaagaacgggaagaaggtgatccagctctcccggaagaccttcgacagcgagtacgtcaagacccgcgccaacgactgggacttcgtggtgacgaccgacatctccgagatgggcgccaacttcaaggcggagcgggtcatcgacccccgccggtgcatgaagcccgtgatcctgaccgacggggaggagcgcgtgatcctggccggccccatgccggtcacccacagctccgccgcccagcggcgcgggcgcatcggccggaaccccaagaacgagaacgaccagtacatctacatgggcgagcccctcgagaacgacgaggactgcgcccactggaaggaggcgaagatgctgctggacaacatcaacacgcccgaggggatcatcccgagcatgttcgagcccgagcgcgagaaggtggacgccatcgacggcgagtaccggctccgcggggaggcccggaagaccttcgtggacctgatgcgccggggcgacctgcccgtctggctcgcctaccgcgtggccgcggaggggatcaactacgccgaccggcgctggtgcttcgacggcatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccgggcgcaagagcctcaccctgaacctgatcacggagatgggccggctccccaccttcatgacccagaaggcccgcgacgccctggacaacctggccgtgctccacaccgcggaggccgggggccgggcctacaaccacgccctgtccgagctgcccgagacgctcgagaccctgctgctcctgaccctgctcgccaccgtcacgggcgggatcttcctgttcctgatgagcggcaaggggatcggcaagatgaccctcgggatgtgctgcatcatcaccgcgtccatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgccatcctgacggtggtggcggccaccatggccaacgagatgggcttcctcgagaagaccaagaaggacctgggcctggggagcatcaccacgcaggagtccgagagcaacatcctcgacatcgacctgcggccggcctccgcctggaccctgtacgcggtcgccaccaccttcgtgacgcccatgctccgccacagcatcgagaactccagcgtgaacgtctccctgaccgccatcgccaaccaggcgaccgtgctgatgggcctcgggaagggctggcccctgagcaagatggacatcggggtgcccctgctcgccatcggctgctactcccaggtcaacccgatcaccctgacggccgccctgctcctgctggtggcccactacgcgatcatcggccccgggctccaggccaaggccacccgggaggcccagaagcgcgccgcggccggcatcatgaagaaccccaccgtggacgggatcaccgtcatcgacctggagcccatcccgtacgaccccaagttcgagaagcagctgggccaggtgatgctcctgatcctgtgcgtgacgcaggtcctcatgatgcgcaccacctgggccctgtgcgaggccctgaccctcgccacggggcccatcagcaccctgtgggagggcaaccccggccggttctggaacaccaccatcgcggtgtccatggccaacatcttccgcgggagctacctggccggcgccgggctcctgttctccatcatgaagaacacgaccaacacccggcgcggcaccggcaacatcggggagacgctgggcgagaagtggaagtcccggctcaacgcgctggggaagtccgagttccagatctacaagaagtccggcatccaggaggtggaccgcaccctggccaaggaggggatcaagcggggcgagaccgaccaccacgccgtctcccgcggcagcgccaagctccggtggttcgtggagcgcaacatggtgaccccggaggggaaggtcgtggacctgggctgcgggcggggcgggtggtcctactactgcggcggcctgaagaacgtgcgcgaggtcaaggggctcacgaagggcgggcccggccacgaggagcccatccccatgagcacctacgggtggaacctggtgcggctgcagagcggcgtggacgtcttcttcaccccgcccgagaagtgcgacaccctcctgtgcgacatcggcgagtccagccccaaccccacgatcgaggccgggcgcaccctgcgggtgctcaacctggtggagaactggctgaacaacaacacccagttctgcatcaaggtcctcaacccgtacatgccctccgtgatcgagaagatggagaccctgcagcgcaagtacggcggggcgctggtgcggaaccccctgagccgcaactccacccacgagatgtactgggtcagcaacgccacgggcaacatcgtgtccagcgtgaacatgatctcccggatgctcatcaaccgcttcaccatgaagcacaagaaggccacctacgagccggacgtcgacctggggagcggcacccgcaacatcggcatcgagtccgagatccccaacctggacatcatcgggaagcggatcgagaagatcaagcaggagcacgagacgagctggcactacgaccaggaccacccctacaagacctgggcctaccacggctcctacgagaccaagcagaccgggagcgcctccagcatggtgaacggcgtggtccgcctcctgacgaagccctgggacgtggtgccgatggtcacccagatggcgatgaccgacaccacgcccttcggccagcagcgggtgttcaaggagaaggtggacacccgcacccaggagcccaaggaggggaccaagaagctgatgaagatcacggccgagtggctctggaaggagctgggcaagaagaagacgccccggatgtgcacccgcgaggagttcacccggaaggtccgctccaacgccgccctgggggccatcttcacggacgagaacaagtggaagtccgcgcgggaggccgtggaggactcccgcttctgggagctcatcgaccgggagcgcaacctgcacctggagggcaagtgcgagacctgcgtgtacaacatgatggggaagcgggagaagaagctcggcgagttcggcaaggccaaggggagccgcgccatctggtacatgtggctgggcgcgcggttcctggagttcgaggccctcgggttcctgaacgaggaccactggttcagccgcggcaactccctgagcggggtcgagggcgagggcctccaccggctggggtacatcctgcgcgacgtgtccaagaaggagggcggggccatgtacgccgacgacaccgccggctgggacacccggatcacgctcgaggacctgaagaacgaggagatggtcaccaaccacatgaagggggagcacaagaagctggcggaggccatcttcaagctcacctaccagaacaaggtggtgcgcgtccagcggccgacgccccgcggcacggtgatggacatcatcagccgccgggaccagcgcggctccggccaggtggggacctacgggctgaacaccttcaccaacatggaggcccagctgatccggcagatggagggcgagggcatcttcaagagcatccagcacctcacggtcaccgaggagatcgccgtgcagaactggctggcccgcgtggggcgggagcgcctgtcccggatggcgatcagcggcgacgactgcgtcgtgaagcccctcgacgaccgcttcgcctccgccctgaccgccctgaacgacatggggaaggtgcggaaggacatccagcagtgggagcccagccgcggctggaacgactggacccaggtcccgttctgctcccaccacttccacgagctcgtgatgaaggacgggcgggtgctggtcgtgccctgccgcaaccaggacgagctgatcggccgggcccgcatcagccagggcgcggggtggtccctcaaggagacggcctgcctgggcaagagctacgcccagatgtggaccctgatgtacttccaccggcgcgacctccggctggccgccaacgcgatctgctccgccgtgcccagccactgggtccccacctcccgcaccacctggagcatccacgccaagcacgagtggatgacgaccgaggacatgctggccgtgtggaaccgggtgtggatccaggagaacccgtggatggaggacaagacccccgtcgagagctgggaggaggtgccctacctcgggaagcgcgaggaccagtggtgcggctccctgatcgggctgaccagccgcgcgacgtgggccaagaacatccagaccgccatcaaccaggtgcggtccctcatcggcaacgaggagtacaccgactacatgcccagcatgaagcgcttccggcgcgaggaggaggaggccggcgtcctgtggtga

SEQ ID NO: 9385 - RNA, 9876 nt, synthetic construct
  misc_feature 1..9876: note = derived and/or modified CDS sequence (opt1) from DENV-2__EU482582__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcggcacccgggcttcaccatcatggccgcgatcctggcctacaccatcgggaccaaccacttccagcgggccctcatcttcatcctgctgacggccgtggcgcccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggccaagctgaccaacacgaccaccgagtcccggtgcccgacccagggcgagcccagcctgaacgaggagcaggacaagcgcttcgtgtgcaagcactccatggtggaccggggctgggggaacggctgcggcctcttcggcaagggcgggatcgtcacgtgcgcgatgttcacgtgcaagaagaacatggagggcaaggtggtgctgcccgagaacctggagtacaccatcgtcatcacgccccacagcggggaggagcacgccgtgggcaacgacacggggaagcacggcaaggagatcaagatcaccccgcagtccagcatcaccgaggccgagctcaccgggtacggcaccgtgacgatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagaccctcgtgacgttcaagaacccccacgcgaagaagcaggacgtcgtggtcctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtgaaggagatcgccgagacccagcacgggaccatcgtgatccgcgtccagtacgagggcgacggctccccctgcaagatccccttcgagatcatggacctcgagaagcggcacgtgctggggcgcctgatcacggtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggccctgcaccaggtgttcggcgcgatctacggcgccgtgttcagcggggtctcctggaccatgaagatcctgatcggcgtgatcatcacctggatcgggatgaacagccgctccacgagcctgtccgtgagcctcgtcctggtgggcgtggtcaccctgtacctcggggccatggtgcaggccgactccggctgcgtggtcagctggaagtccaaggagctgaagtgcggcagcgggatcttcatcaccgacaacgtgcacacctggacggagcagtacaagttccagcccgagagcccctccaagctggcgagcgccatccagaaggcccacgaggagggcatctgcgggatccggtccgtgacccgcctcgagaacctgatgtggaagcagatcacccccgagctgaaccacatcctcagcgagaacgaggtcaagctgaccatcatgacgggcgacatcaaggggatcatgcaggccggcaagcggtccctgcgcccgcagcccaccgagctcaagtacagctggaagacctggggcaaggccaagatgctgtccaccgagagccacaaccagacgttcctgatcgacgggcccgagaccgcggagtgcccgaacaccaaccgggcctggaactccctcgaggtggaggactacggcttcggggtgttcaccacgaacatctggctgaagctgcgcgagaagcaggacgtcttctgcgacagcaagctcatgtccgccgccatcaaggacaaccgggccgtgcacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtcgtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtcacggccgggcacggccagatcgacaacttcagcctgggcgtgctggggatggccctcttcctggaggagatgctgcggacccgcgtgggcaccaagcacgccatcctcctggtcgcggtgtccttcgtgaccctgatcacggggaacatgagcttccgggacctcggccgcgtcatggtgatggtgggggccaccatgaccgacgacatcggcatgggcgtcacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtccgcaacatggagaagtaccagctggccgtgaccatcatggccatcagctgcgtgccgaacgccgtcatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccatcatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcctcggctacagccagatcggcgcgggggtctacaaggagggcaccttccacaccatgtggcacgtgacccgcggggccgtgctgatgcaccgcggcaagcggatcgagccctcctgggccgacgtcaagaaggacctgatcagctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgcggtgtccctggacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtcgtggccgcggagatggaggaggccctgcgggggctccccatccgctaccagacccccgccatccgggccgagcacacgggccgcgagatcgtggacctgatgtgccacgccaccttcaccatgcggctgctctcccccgtccgcgtgccgaactacaacctgatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctctcccggaagaccttcgacagcgagtacgtgaagacccgcgccaacgactgggacttcgtggtcaccacggacatctccgagatgggggccaacttcaaggccgagcgggtgatcgacccccgccggtgcatgaagcccgtgatcctgaccgacggcgaggagcgcgtcatcctggcggggcccatgccggtgacccacagctccgccgcccagcggcgcggccgcatcgggcggaaccccaagaacgagaacgaccagtacatctacatgggcgagcccctcgagaacgacgaggactgcgcccactggaaggaggccaagatgctgctggacaacatcaacacccccgagggcatcatcccgagcatgttcgagcccgagcgcgagaaggtggacgcgatcgacggggagtaccggctccgcggcgaggcccggaagacgttcgtcgacctgatgcgccgcggggacctgcccgtgtggctcgcctaccgcgtggccgccgagggcatcaactacgcggaccggcgctggtgcttcgacgggatcaagaacaaccagatcctggaggagaacgtcgaggtggagatctggaccaaggagggcgagcggaagaagctgaagccgcgctggctcgacgcccggatctactccgaccccctggccctgaaggagttcaaggagttcgccgcgggccgcaagagcctcaccctgaacctgatcaccgagatggggcggctccccacgttcatgacccagaaggcccgcgacgccctggacaacctggccgtcctccacaccgccgaggcgggcgggcgggcctacaaccacgccctgtccgagctgcccgagaccctcgagacgctgctgctcctgaccctgctcgccaccgtgaccggcggcatcttcctgttcctgatgagcgggaagggcatcgggaagatgacgctcggcatgtgctgcatcatcaccgcctccatcctgctgtggtacgcgcagatccagccgcactggatcgccgccagcatcatcctcgagttcttcctgatcgtgctgctcatccccgagcccgagaagcagcgcacgccccaggacaaccagctgacctacgtcgtgatcgccatcctgaccgtggtcgccgcgacgatggccaacgagatggggttcctcgagaagaccaagaaggacctgggcctgggcagcaccaccacgcaggagtccgagagcaacatcctcgacatcgacctgcggccggcctccgcctggaccctgtacgccgtggcgaccaccttcgtgacgcccatgctccgccacagcatcgagaactccagcgtcaacgtgtccctgaccgccatcgccaaccaggccaccgtgctgatggggctcggcaaggggtggcccctgagcaagatggacatcggcgtccccctgctcgcgatcgggtgctactcccaggtgaacccgatcaccctgacggccgccctgctcctgctggtggcccactacgccatcatcggccccggcctccaggcgaaggccacccgggaggcccagaagcgcgccgccgcggggatcatgaagaaccccaccgtcgacggcatcaccgtgatcgacctggagcccatcccgtacgaccccaagttcgagaagcagctgggccaggtgatgctcctgatcctgtgcgtcacccaggtgctcatgatgcgcaccacctgggccctgtgcgaggccctgaccctcgccacgggccccatcagcaccctgtgggaggggaaccccggccggttctggaacaccaccatcgccgtgtccatggcgaacatcttccgcggcagctacctggccggggccggcctcctgttctccatcatgaagaacacgaccaacacccggcgcgggaccggcaacatcggcgagacgctgggggagaagtggaagtcccggctcaacgccctgggcaagtccgagttccagatctacaagaagtccgggatccaggaggtcgaccgcaccctggcgaaggagggcatcaagcgcggggagaccgaccaccacgccgtgtcccgcggcagcgccaagctccggtggttcgtggagcgcaacatggtcaccccggagggcaaggtggtggacctggggtgcggccgcggcgggtggtcctactactgcggcgggctgaagaacgtccgcgaggtgaaggggctcacgaagggcgggcccgggcacgaggagcccatccccatgagcacctacggctggaacctggtgcggctgcagagcggggtcgacgtgttcttcaccccgcccgagaagtgcgacaccctcctgtgcgacatcggcgagtccagccccaaccccacgatcgaggccggccgcaccctgcgggtgctcaacctggtcgagaactggctgaacaacaacacccagttctgcatcaaggtgctcaacccgtacatgccctccgtgatcgagaagatggagaccctgcagcgcaagtacgggggcgccctggtccggaaccccctgagccgcaactccacccacgagatgtactgggtgagcaacgcgacggggaacatcgtgtccaccgtcaacatgatcagccggatgctcatcaaccgcttcaccatgaagcacaagaaggccacctacgagccggacgtggacctgggctccgggacgcgcaacatcggcatcgagagcgagatccccaacctggacatcatcggcaagcggatcgagaagatcaagcaggagcacgagacctcctggcactacgaccaggaccacccctacaagacctgggcctaccacgggagctacgagaccaagcagacgggctccgccagctccatggtgaacggggtcgtgcgcctcctgaccaagccctgggacgtggtcccgatggtgacccagatggccatgaccgacacgacccccttcggccagcagcgggtgttcaaggagaaggtcgacacccgcacccaggagcccaaggagggcacgaagaagctgatgaagatcaccgcggagtggctctggaaggagctggggaagaagaagacgccccggatgtgcacccgcgaggagttcacgcggaaggtgcgcagcaacgccgccctgggcgccatcttcaccgacgagaacaagtggaagtccgcccgggaggcggtggaggacagccgcttctgggagctcatcgaccgggagcgcaacctgcacctggaggggaagtgcgagacctgcgtctacaacatgatgggcaagcgggagaagaagctcggggagttcggcaaggccaagggctcccgcgccatctggtacatgtggctgggggcccggttcctggagttcgaggcgctcggcttcctgaacgaggaccactggttcagccgcgggaacagcctgtccggcgtggagggggagggcctccaccggctgggctacatcctgcgcgacgtcagcaagaaggagggcggggccatgtacgccgacgacaccgccgggtgggacacgcggatcaccctcgaggacctgaagaacgaggagatggtgaccaaccacatgaagggcgagcacaagaagctggccgaggcgatcttcaagctcacctaccagaacaaggtggtccgcgtgcagcggccgacgccccgcgggaccgtgatggacatcatctcccgccgggaccagcgcggcagcggccaggtcgggacctacggcctgaacaccttcacgaacatggaggcccagctgatccggcagatggagggggagggcatcttcaagtccatccagcacctcaccgtgaccgaggagatcgccgtgcagaactggctggcccgcgtcggccgggagcgcctgagccggatggccatctccggggacgactgcgtggtgaagcccctcgacgaccgcttcgcgagcgccctgaccgccctgaacgacatgggcaaggtccggaaggacatccagcagtgggagccctcccgcgggtggaacgactggacccaggtgccgttctgcagccaccacttccacgagctcgtgatgaaggacggccgggtcctggtggtgccctgccgcaaccaggacgagctgatcgggcgggcccgcatctcccagggcgccggctggagcctcaaggagaccgcgtgcctggggaagtcctacgcccagatgtggaccctgatgtacttccaccggcgcgacctccggctggccgccaacgccatctgcagcgcggtcccctcccactgggtgcccaccagccgcaccacgtggtccatccacgccaagcacgagtggatgaccaccgaggacatgctggccgtgtggaaccgggtctggatccaggagaacccgtggatggaggacaagacccccgtggagagctgggaggaggtgccctacctcggcaagcgcgaggaccagtggtgcgggagcctgatcggcctgacgtcccgcgccacctgggcgaagaacatccagaccgccatcaaccaggtccggagcctcatcgggaacgaggagtacaccgactacatgccctccatgaagcgcttccggcgcgaggaggaggaggccggcgtgctgtggtga

SEQ ID NO: 9386 - RNA, 9876 nt, synthetic construct
  misc_feature 1..9876: note = derived and/or modified CDS sequence (opt1) from DENV-2__EU482583__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtggagggcgtcagcgggggcagctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagaacaaggagctgaagtgcggctccgggatcttcatcaccgacaacgtccacacgtggaccgagcagtacaagttccagcccgagagccccagcaagctggcctccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggcgaagatgctgagcacggagtcccacaaccagaccttcctgatcgacgggcccgagaccgccgagtgcccgaacaccaaccgggcctggaacagcctcgaggtcgaggactacggcttcggggtgttcacgaccaacatctggctgaagctgcgcgagaagcaggacgtgttctgcgactccaagctcatgagcgccgccatcaaggacaaccgggcggtccacgccgacatgggctactggatcgagtccgccctgaacgacacctggaagatggagaaggccagcttcatcgaggtgaagtcctgccactggcccaagagccacaccctgtggtccaacggcgtgctcgagagcgagatgatcatccccaagaacttcgccgggcccgtctcccagcacaactaccgcccgggctaccacacccagacggcggggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcgtgggcaccaagcacgcgatcctcctggtggccgtcagcttcgtgacgctgatcaccgggaacatgtccttccgggacctcggccgcgtgatggtcatggtgggggccaccatgaccgacgacatcggcatgggcgtgacgtacctggccctgctcgccgcgttcaaggtccgccccaccttcgccgccgggctgctgctccggaagctgaccagcaaggagctgatgatggccaccatcggcatcgccctcctgtcccagagcacgatccccgagaccatcctggagctcaccgacgcgctggccctggggatgatggtgctcaagatcgtgcgcaacatggagaagtaccagctggccgtcaccatcatggccatctcctgcgtgccgaacgccgtgatcctgcagaacgcgtggaaggtcagctgcacgatcctcgccgccgtgtccgtcagccccctgctgctcacctccagccagcagaaggccgactggatccccctggcgctgaccatcaagggcctcaaccccaccgccatcttcctgacgaccctgtcccggaccagcaagaagcgctcctggccgctcaacgaggccatcatggccgtgggcatggtgagcatcctggcctccagcctgctcaagaacgacatccccatgaccgggcccctggtcgcgggcgggctgctcacggtgtgctacgtgctgaccggccggagcgccgacctggagctcgagcgcgccgccgacgtcaagtgggaggaccaggccgagatctccgggagctcccccatcctgagcatcaccatctccgaggacggcagcatgtccatcaagaacgaggaggaggagcagaccctgacgatcctcatccggaccggcctgctggtgatcagcggggtgttcccggtctccatccccatcaccgcggccgcctggtacctctgggaggtgaagaagcagcgcgccggcgtgctgtgggacgtccccagcccgccgcccgtggggaaggccgagctggaggacggcgcgtaccggatcaagcagcgcgggatcctcggctactcccagatcggcgccggggtgtacaaggagggcaccttccacaccatgtggcacgtcacgcgcggggccgtgctgatgcaccgcggcaagcggatcgagcccagctgggccgacgtgaagaaggacctgatctcctacgggggcggctggaagctcgagggggagtggaaggagggcgaggaggtccaggtgctggccctggagcccgggaagaacccccgcgcggtgcagaccaagcccggcctcttcaagaccaacaccgggacgatcggcgccgtcagcctggacttctcccccggcaccagcgggtcccccatcgtggaccggaagggcaaggtggtcgggctgtacggcaacggcgtggtgacccgcagcggggcctacgtctccgccatcgcgcagaccgagaagtccatcgaggacaaccccgagatcgaggacgacatcttccggaagaagcgcctcacgatcatggacctgcaccccggcgccgggaagaccaagcggtacctgcccgccatcgtgcgcgaggccatcaagcggggcctgcgcaccctcatcctggccccgacccgcgtggtcgcggccgagatggaggaggccctgcgggggctccccatccgctaccagacgcccgccatccgggccgagcacaccggccgcgagatcgtggacctgatgtgccacgcgaccttcaccatgcggctgctcagccccgtgcgcgtcccgaactacaacctgatcatcatggacgaggcccacttcacggaccccgcctccatcgccgcccggggctacatcagcacccgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggcgggcaacgacatcgccgcctgcctgcgcaagaacggcaagaaggtgatccagctcagccggaagaccttcgacgccgagtacgtcaagacccgcgccaacgactgggacttcgtggtgacgaccgacatctccgagatgggggcgaacttcaaggccgagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacgcccgagggcatcatcccgagcatgttcgagcccgagcgcgagaaggtggacgccatcgacggggagtaccggctccgcggcgaggcccggaagaccttcgtggacctgatgcgccgcggggacctgcccgtctggctcgcctaccgcgtggcggccgagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggcgctgaaggagttcaaggagttcgccgccggccgcaagagcctcaccctgaacctgatcacggagatggggcggctccccaccttcatgacccagaaggcccgcgacgccctggacaacctggcggtgctccacaccgccgaggccggcgggcgggcctacaaccacgccctgtccgagctgcccgagacgctcgagaccctgctgctcctgaccctgctcgcgaccgtcacgggcggcatcttcctgttcctgatgagcgggaagggcatcgggaagatgaccctcggcatgtgctgcatcatcaccgcctccatcctgctgtggtacgcccagatccagccgcactggatcgccgccagcatcatcctcgagttcttcctgatcgtgctgctcatccccgagcccgagaagcagcgcacgccccaggacaaccagctgacctacgtggtcatcgcgatcctgacggtggtggccgccaccatggccaacgagatggggttcctcgagaagaccaagaaggacctgggcctgggctccatcaccacgcaggagagcgagagcaacatcctcgacatcgacctgcggccggcctccgcgtggaccctgtacgccgtcgccaccaccttcgtgacgcccatgctccgccacagcatcgagaactccagcgtgaacgtctccctgaccgccatcgcgaaccaggccaccgtgctgatggggctcggcaaggggtggcccctgagcaagatggacatcggcgtgcccctgctcgccatcgggtgctactcccaggtcaacccgatcaccctgacggccgccctgctcctgctggtggcgcactacgccatcatcggccccggcctccaggccaaggccacccgggaggcccagaagcgcgcggccgccgggatcatgaagaaccccaccgtggacggcatcaccgtcatcgacctggagcccatcccgtacgaccccaagttcgagaagcagctggggcaggtcatgctcctgatcctgtgcgtgacgcaggtcctcatgatgcgcaccacctgggccctgtgcgaggccctgaccctcgcgacgggccccatcagcaccctgtgggaggggaaccccggccggttctggaacaccaccatcgccgtgtccatggccaacatcttccgcggcagctacctggccggggcgggcctcctgttctccatcatgaagaacacgaccaacacccggcgcgggaccggcaacatcggcgagacgctgggggagaagtggaagtcccggctcaacgccctgggcaagtccgagttccagatctacaagaagtccgggatccaggaggtggaccgcaccctggccaaggagggcatcaagcgcggggagaccgaccaccacgccgtctcccgcggcagcgccaagctccggtggttcgtggagcgcaacatggtgaccccggagggcaaggtcgtggacctggggtgcggccgcggcgggtggtcctactactgcggcgggctgaagaacgtgcgcgaggtcaaggggctcacgaagggcgggcccgggcacgaggagcccatccccatgagcacctacggctggaacctggtgcggctgcagtccggggtggacgtcttcttcaccccgcccgagaagtgcgacaccctcctgtgcgacatcggcgagagcagccccaaccccacgatcgaggcgggccgcaccctgcgggtgctcaacctggtggagaactggctgaacaacaacacccagttctgcatcaaggtcctcaacccgtacatgccctccgtgatcgagaagatggagaccctgcagcgcaagtacgggggcgccctggtgcggaaccccctgagccgcaactccacccacgagatgtactgggtcagcaacgccacggggaacatcgtgtccagcgtgaacatgatctcccggatgctcatcaaccgcttcaccatgaagcacaagaaggccacctacgagccggacgtcgacctgggcagcgggacccgcaacatcggcatcgagtccgagatccccaacctggacatcatcggcaagcggatcgagaagatcaagcaggagcacgagacgagctggcactacgaccaggaccacccctacaagacctgggcctaccacgggtcctacgagaccaagcagaccggcagcgcgtccagcatggtgaacggggtggtccgcctcctgacgaagccctgggacgtggtgccgatggtcacccagatggccatgaccgacaccacgcccttcggccagcagcgggtgttcaaggagaaggtggacacccgcacccaggagcccaaggagggcaccaagaagctgatgaagatcacggccgagtggctctggaaggagctggggaagaagaagacgccccggatgtgcacccgcgaggagttcacccggaaggtccgctccaacgccgccctgggcgcgatcttcacggacgagaacaagtggaagtccgcccgggaggccgtggaggactcccgcttctgggagctcatcgaccgggagcgcaacctgcacctggaggggaagtgcgagacctgcgtgtacaacatgatgggcaagcgggagaagaagctcggggagttcggcaaggccaagggcagccgcgcgatctggtacatgtggctgggggcccggttcctggagttcgaggccctcggcttcctgaacgaggaccactggttctcccgcgggaacagcctgagcggcgtcgagggggagggcctccaccggctgggctacatcctgcgcgacgtgtccaagaaggagggcggggccatgtacgccgacgacaccgcggggtgggacacccggatcacgctcgaggacctgaagaacgaggagatggtcaccaaccacatgaagggcgagcacaagaagctggccgaggccatcttcaagctcacctaccagaacaaggtggtgcgcgtccagcggccgacgccccgggggacggtgatggacatcatcagccgccgggaccagcgcggctccggccaggtggggacctacggcctgaacaccttcaccaacatggaggcccagctgatccggcagatggagggggagggcatcttcaagagcatccagcacctcacggtcaccgaggagatcgccgtgcagaactggctggcgcgcgtgggccgggagcgcctgtcccggatggccatcagcggggacgactgcgtcgtgaagcccctcgacgaccgcttcgcctccgccctgaccgccctgaacgacatgggcaaggtgcggaaggacatccagcagtgggagcccagccgcgggtggaacgactggacccaggtcccgttctgctcccaccacttccacgagctcgtgatgaaggacggccgggtgctggtcgtgccctgccgcaaccaggacgagctgatcgggcgggcgcgcatcagccagggcgccggctggtccctcaaggagacggcctgcctgggcaagagctacgcccagatgtggaccctgatgtacttccaccggcgcgacctccggctggccgcgaacgccatctgctccgccgtgcccagccactgggtccccacctcccgcaccacctggagcatccacgccaagcacgagtggatgacgaccgaggacatgctggcggtgtggaaccgggtgtggatccaggagaacccgtggatggaggacaagacccccgtcgagtcctgggaggaggtgccctacctcggcaagcgcgaggaccagtggtgcgggagcctgatcggcctgaccagccgcgccacgtgggccaagaacatccagaccgccatcaaccaggtgcggtccctcatcgggaacgaggagtacaccgactacatgcccagcatgaagcgcttccggcgcgaggaggaggaggccggcgtcctgtggtga

SEQ ID NO: 9387 - RNA, 9876 nt, synthetic construct
  misc_feature 1..9876: note = derived and/or modified CDS sequence (opt1) from DENV-2__EU482585__SS-prME
  source 1..9876: mol_type = other RNA
accgcgggcgtgatcatcatgctgatccccaccgccatcgcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggccatggtccaggcggactccggctgcgtggtgagctggaagtccaaggagctgaagtgcggcagcgggatcttcatcaccgacaacgtccacacgtggaccgagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgacgatcatgaccggcgggatcaagggcatcatgcaggccggcaagcggtccctgcgcccgcagcccaccgagctcaagtacagctggaagacctgggggaaggcgaagatgctgtccacggagagccacaaccagaccttcctgatcgacggccccgagaccgccgagtgcccgaacaccaaccgggcctggaactccctcgaggtcgaggactacgggttcggcgtgttcacgaccaacatctggctgaagctgcgcgagaagcaggacgtgttctgcgacagcaagctcatgtccgccgccatcaaggacaaccgggcggtccacgccgacatgggctactggatcgagagcgccctgaacgacacctggaagatggagaaggcctccttcatcgaggtcaagagctgccactggcccaagtcccacaccctgtggagcaacggggtgctcgagtccgagatggtgatccccaagaacttcgccggccccgtgagccagcacaactaccgcccggggtaccacacccagacggcgggcccctggcacctggggaagctggagatggacttcgacttctgcgagggcaccaccgtggtcgtgaccgaggactgcggcaaccgggggcccagcctccgcacgaccaccgcctccggcaagctgatcaccgagtggtgctgccggagctgcacgctgcccccgctccgctaccgcggggaggacggctgctggtacgggatggagatccgccccctgaaggagaaggaggagaacctggtgaactccctcgtcaccgccggccacggccagatcgacaacttcagcctgggggtgctgggcatggccctcttcctggaggagatgctgcggacccgcgtggggaccaagcacgcgatcctcctggtcgccgtgtccttcgtgacgctgatcaccggcaacatgagcttccgggacctcgggcgcgtcatggtgatggtgggcgccaccatgaccgacgacatcggcatgggggtcacgtacctggccctgctcgccgcgttcaaggtgcgccccaccttcgccgccggcctgctgctccggaagctgacctccaaggagctgatgatggccaccatcgggatcgccctcctgagccagtccacgatccccgagaccatcctggagctcaccgacgcgctggccctgggcatgatggtgctcaagatcgtccgcaacatggagaagtaccagctggccgtgaccatcatggccatcagctgcgtgccgaacgccgtcatcctgcagaacgcgtggaaggtgtcctgcacgatcctcgccgccgtcagcgtgagccccctgctgctcaccagctcccagcagaaggccgactggatccccctggcgctgaccatcaagggcctcaaccccaccgccatcttcctgacgaccctgagccggacctccaagaagcgcagctggccgctcaacgaggccatcatggccgtggggatggtctccatcctggccagcagcctgctcaagaacgacatccccatgaccggccccctggtggccggcgggctgctcacggtgtgctacgtcctgaccgggcggtccgccgacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgacgatcctcatccggaccgggctgctggtgatctccggcgtcttcccggtgagcatccccatcaccgcggccgcctggtacctctgggaggtgaagaagcagcgcgccggggtcctgtgggacgtgcccagcccgccgcccgtgggcaaggccgagctggaggacggggcgtaccggatcaagcagcgcggcatcctcggctacagccagatcggggccggcgtctacaaggaggggaccttccacaccatgtggcacgtgacgcggggcgccgtgctgatgcaccgcgggaagcggatcgagccctcctgggccgacgtcaagaaggacctgatcagctacggcggcgggtggaagctcgagggcgagtggaaggagggggaggaggtccaggtgctggccctggagcccggcaagaacccccgcgcggtccagaccaagcccggcctcttcaagaccaacaccggcacgatcggcgccgtgtccctggacttcagccccgggacctccggcagccccatcgtggaccggaaggggaaggtcgtgggcctgtacggcaacggggtggtcacccgctccggcgcctacgtgagcgccatcgcgcagaccgagaagtccatcgaggacaaccccgagatcgaggacgacatcttccggaagaagcgcctcacgatcatggacctgcaccccggggccggcaagaccaagcggtacctgcccgccatcgtgcgcgaggccatcaagcgggggctgcgcaccctcatcctggccccgacccgcgtcgtggcggccgagatggaggaggccctgcggggcctccccatccgctaccagacgcccgccatccgggccgagcacaccggccgcgagatcgtggacctgatgtgccacgcgaccttcaccatgcggctgctctcccccgtccgcgtgccgaactacaacctgatcatcatggacgaggcccacttcacggaccccgccagcatcgccgcccgggggtacatctccacccgcgtggagatgggcgaggcggccgggatcttcatgaccgccacgccgcccggcagccgggacccgttcccccagtccaacgcccccatcatggacgaggagcgcgagatccccgagcggagctggaactccgggcacgagtgggtcacggacttcaagggcaagaccgtgtggttcgtgccgagcatcaaggcgggcaacgacatcgccgcctgcctgcgcaagaacgggaagaaggtcatccagctctcccggaagaccttcgacagcgagtacgtgaagacccgcgccaacgactgggacttcgtggtcacgaccgacatctccgagatgggcgccaacttcaaggcggagcgggtgatcgacccccgccggtgcatgaagcccgtgatcctgaccgacggggaggagcgcgtcatcctggccggccccatgccggtgacccacagctccgccgcccagcggcgcgggcgcatcggccggaaccccaagaacgagaacgaccagtacatctacatgggcgagcccctcgagaacgacgaggactgcgcccactggaaggaggcgaagatgctgctggacaacatcaacacgcccgaggggatcatcccgagcatgttcgagcccgagcgcgagaaggtggacgccatcgacggcgagtaccggctccgcggggaggcccggaagaccttcgtcgacctgatgcgccggggcgacctgcccgtgtggctcgcctaccgcgtggccgcggaggggatcaactacgccgaccggcgctggtgcttcgacggcatcaagaacaaccagatcctggaggagaacgtcgaggtggagatctggaccaaggagggcgagcggaagaagctgaagccgcgctggctcgacgcccggatctactccgaccccctggccctgaaggagttcaaggagttcgcggccgggcgcaagagcctcaccctgaacctgatcacggagatgggccggctccccaccttcatgacccagaaggcccgcgacgccctggacaacctggccgtcctccacaccgcggaggccgggggccgggcctacaaccacgccctgtccgagctgcccgagacgctcgagaccctgctgctcctgaccctgctcgccaccgtgacgggcgggatcttcctgttcctgatgagcggcaaggggatcggcaagatgaccctcgggatgtgctgcatcatcaccgcgtccatcctgctgtggtacgcccagatccagccgcactggatcgccgccagcatcatcctcgagttcttcctgatcgtgctgctcatccccgagcccgagaagcagcgcacgccccaggacaaccagctgacctacgtcgtgatcgccatcctgacggtggtcgcggccaccatggccaacgagatgggcttcctcgagaagaccaagaaggacctgggcctggggagcatcaccacgcaggagtccgagagcaacatcctcgacatcgacctgcggccggcctccgcctggaccctgtacgcggtggccaccaccttcgtgacgcccatgctccgccacagcatcgagaactccagcgtcaacgtgtccctgaccgccatcgccaaccaggcgaccgtgctgatgggcctcgggaagggctggcccctgagcaagatggacatcggggtccccctgctcgccatcggctgctactcccaggtgaacccgatcaccctgacggccgccctgctcctgctggtggcccactacgcgatcatcggccccgggctccaggccaaggccacccgggaggcccagaagcgcgccgcggccggcatcatgaagaaccccaccgtcgacgggatcaccgtgatcgacctggagcccatcccgtacgaccccaagttcgagaagcagctgggccaggtgatgctcctgatcctgtgcgtcacccaggtgctcatgatgcgcaccacctgggccctgtgcgaggccctgaccctcgccacggggcccatcagcaccctgtgggagggcaaccccggccggttctggaacaccaccatcgcggtgtccatggccaacatcttccgcgggagctacctggccggcgccgggctcctgttctccatcatgaagaacacgaccaacacccggcgcggcaccggcaacatcggggagacgctgggcgagaagtggaagtcccggctcaacgcgctggggaagtccgagttccagatctacaagaagtccggcatccaggaggtcgaccgcaccctggccaaggaggggatcaagcggggcgagaccgaccaccacgccgtgtcccgcggcagcgccaagctccggtggttcgtggagcgcaacatggtcaccccggaggggaaggtggtggacctgggctgcgggcggggcgggtggtcctactactgcggcggcctgaagaacgtccgcgaggtgaaggggctcacgaagggcgggcccggccacgaggagcccatccccatgagcacctacgggtggaacctggtgcggctgcagagcggcgtcgacgtgttcttcaccccgcccgagaagtgcgacaccctcctgtgcgacatcggcgagtccagccccaaccccacgatcgaggccgggcgcaccctgcgggtgctcaacctggtcgagaactggctgaactccaacacccagttctgcatcaaggtgctcaacccgtacatgcccagcgtgatcgagaagatggagaccctgcagcgcaagtacggcggggcgctggtccggaaccccctgtcccgcaacagcacccacgagatgtactgggtgtccaacgccacgggcaacatcgtgagctccgtcaacatgatcagccggatgctcatcaaccgcttcaccatgaagcacaagaaggccacctacgagccggacgtggacctggggtccggcacccgcaacatcggcatcgagagcgagatccccaacctggacatcatcgggaagcggatcgagaagatcaagcaggagcacgagacgtcctggcactacgaccaggaccacccctacaagacctgggcctaccacggcagctacgagaccaagcagaccgggtccgccagctccatggtgaacggcgtcgtgcgcctcctgacgaagccctgggacgtggtcccgatggtgacccagatggcgatgaccgacaccacgcccttcggccagcagcgggtgttcaaggagaaggtcgacacccgcacccaggagcccaaggaggggaccaagaagctgatgaagatcacggccgagtggctctggaaggagctgggcaagaagaagacgccccggatgtgcacccgcgaggagttcacccggaaggtgcgcagcaacgccgccctgggggccatcttcacggacgagaacaagtggaagtccgcgcgggaggccgtggaggacagccgcttctgggagctcatcgaccgggagcgcaacctgcacctggagggcaagtgcgagacctgcgtctacaacatgatggggaagcgggagaagaagctcggcgagttcggcaaggccaaggggagccgcgccatctggtacatgtggctgggcgcgcggttcctggagttcgaggccctcgggttcctgaacgaggaccactggttctcccgcggcaacagcctgtccggggtggagggcgagggcctccaccggctggggtacatcctgcgcgacgtcagcaagaaggagggcggggccatgtacgccgacgacaccgccggctgggacacccggatcacgctcgaggacctgaagaacgaggagatggtgaccaaccacatgaagggggagcacaagaagctggcggaggccatcttcaagctcacctaccagaacaaggtggtccgcgtgcagcggccgacgccccgcggcacggtgatggacatcatctcccgccgggaccagcgcggcagcgggcaggtcggcacctacgggctgaacaccttcaccaacatggaggcccagctgatccggcagatggagggcgagggcatcttcaagtccatccagcacctcacggtgaccgaggagatcgccgtgcagaactggctggcccgcgtcgggcgggagcgcctgagccggatggcgatctccggcgacgactgcgtggtgaagcccctcgacgaccgcttcgccagcgccctgaccgccctgaacgacatggggaaggtccggaaggacatccagcagtgggagccctcccgcggctggaacgactggacccaggtgccgttctgcagccaccacttccacgagctcgtgatgaaggacgggcgggtcctggtggtgccctgccgcaaccaggacgagctgatcggccgggcccgcatctcccagggcgcggggtggagcctcaaggagacggcctgcctgggcaagtcctacgcccagatgtggaccctgatgtacttccaccggcgcgacctccggctggccgccaacgcgatctgcagcgccgtcccctcccactgggtgcccaccagccgcaccacctggagcatccacgccaagcacgagtggatgacgaccgaggacatgctggccgtgtggaaccgggtctggatccaggagaacccgtggatggaggacaagacccccgtggagtcctgggaggagatcccctacctcgggaagcgcgaggaccagtggtgcggcagcctgatcgggctgacctcccgcgcgacgtgggccaagaacatccagaccgccatcaaccaggtgcggagcctcatcggcaacgaggagtacaccgactacatgccctccatgaagcgcttccggcgcgaggaggaggaggccggcgtcctgtggtga

SEQ ID NO: 9388 - RNA, 9876 nt, synthetic construct
  misc_feature 1..9876: note = derived and/or modified CDS sequence (opt1) from DENV-2__EU482587__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggtggagctcaccgggtacggcacggtcaccatggagtgcagcccccggaccggcctggacttcaacgagatggtgctgctccagatggaggacaaggcctggctggtgcaccggcagtggttcctggacctccccctgccctggctgccgggggccgacacccagggcagcaactggatccagaaggagacgctcgtcaccttcaagaacccccacgccaagaagcaggacgtggtcgtgctggggtcccaggagggcgcgatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctcgagaagcggcacgtgctggggcgcctgatcaccgtcaacccgatcgtgaccgagaaggacagccccgtgaacatcgaggccgagccgcccttcggcgactcctacatcatcatcggggtcgagccgggccagctcaagctgaactggttcaagaaggggagctccatcggccagatgttcgagaccacgatgcgcggcgcgaagcggatggccatcctgggggacaccgcctgggacttcggcagcctcgggggcgtgttcacctccatcgggaaggccctgcaccaggtgttcggcgccatctacggcgcggccttcagcggggtctcctggaccatgaagatcctgatcggcgtgatcatcacgtggatcgggatgaacagccgctccaccagcctgtccgtgagcctcgtcctggtgggcgtggtcaccctgtacctcggggccatggtgcaggccgactccggctgcgtggtcagctggaagtcccgggagctgaagtgcggcagcgggatcttcatcaccgacaacgtgcacacgtggaccgagcagtacaagttccagcccgagagcccctccaagctggcgagcgccatccagaaggcccacgaggagggcatctgcgggatccgctccgtgacccggctcgagaacctgatgtggaagcagatcacccccgagctgaaccacatcctcagcgagaacgaggtcaagctgacgatcatgaccggcgacatcaaggggatcatgcaggccggcaagcgctccctgcggccgcagcccaccgagctcaagtacagctggaagacctggggcaaggccaagatgctgtccacggagagccacaaccgcaccttcctgatcgacgggcccgagaccgcggagtgcccgaacaccaaccgggcctggaactccctcgaggtggaggactacggcttcggggtgttcacgaccaacatctggctgaagctgcgcgagaagcaggacgtcttctgcgacagcaagctcatgtccgccgccatcaaggacaaccgggccgtgcacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagacggccgggccctggcacctgggcaagctggagatggacttcgacttctgcgaggggaccaccgtggtcgtgaccgaggactgcggcaaccggggccccagcctccgcacgaccaccgcgtccgggaagctgatcaccgagtggtgctgccggagctgcacgctgcccccgctccgctaccggggcgaggacgggtgctggtacggcatggagatccgccccctgaaggagaaggaggagaacctggtgaactccctcgtcaccgccgggcacggccagatcgacaacttcagcctgggcgtgctggggatggccctcttcctggaggagatgctgcggacccgcgtgggcaccaagcacgccatcctcctggtcgcggtgtccttcgtgacgctgatcaccgggaacatgagcttccgcgacctcggccgggtcatggtgatggtgggggccaccatgaccgacgacatcggcatgggcgtcacgtacctggccctgctcgccgccttcaaggtgcgccccaccttcgcggccgggctgctgctccggaagctgacctccaaggagctgatgatggccaccatcggcatcgccctcctgagccagtccacgatccccgagaccatcctggagctcaccgacgccctggcgctggggatgatggtgctcaagatcgtccgcaacatggagaagtaccagctggccgtgaccatcatggccatcagctgcgtgccgaacgccgtcatcctgcagaacgcctggaaggtgtcctgcacgatcctcgcggccgtcagcgtgagccccctgctgctcaccagctcccagcagaaggccgactggatccccctggccctgaccatcaagggcctcaaccccaccgcgatcttcctgacgaccctgagccggacctccaagaagcgcagctggccgctcaacgaggccatcatggccgtgggcatggtctccatcctggccagcagcctgctcaagaacgacatccccatgaccgggcccctggtggccggcgggctgctcacggtgtgctacgtcctgaccggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgacgatcctcatccggaccggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcctcggctacagccagatcggcgcgggggtctacaaggagggcaccttccacaccatgtggcacgtgacgcgcggggccgtgctgatgcaccgcggcaagcggatcgagccctcctgggccgacgtcaagaaggacctgatcagctacgggggcggctggaagctcgagggggagtggaaggagggcgaggaggtccaggtgctggccctggagcccgggaagaacccccgcgccgtccagaccaagcccggcctcttcaagaccaacaccgggacgatcggcgcggtgtccctggacttcagccccggcacctccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctcacgatcatggacctgcaccccggcgcggggaagaccaagcggtacctgcccgccatcgtgcgcgaggccatcaagcgcggcctgcggaccctcatcctggccccgacccgcgtcgtggccgcggagatggaggaggccctgcgggggctccccatccgctaccagacgcccgccatccgggccgagcacaccggccgcgagatcgtggacctgatgtgccacgccaccttcaccatgcggctgctctcccccgtccgcgtgccgaactacaacctgatcatcatggacgaggcgcacttcacggaccccgccagcatcgccgcccggggctacatctccacccgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcacggacttcaaggggaagaccgtgtggttcgtgccgagcatcaaggccggcaacgacatcgcggcctgcctgcgcaagaacggcaagaaggtcatccagctctcccggaagaccttcgacagcgagtacgtgaagacccgcgccaacgactgggacttcgtggtcacgaccgacatctccgagatgggggccaacttcaaggccgagcgggtgatcgacccccgccggtgcatgaagcccgtgatcctgaccgacggcgaggagcgcgtcatcctggcggggcccatgccggtgacccacagctccgccgcccagcgccggggccgcatcgggcggaaccccaagaacgagaacgaccagtacatctacatgggcgagcccctcgagaacgacgaggactgcgcccactggaaggaggccaagatgctgctggacaacatcaacacgcccgagggcatcatcccgagcatgttcgagcccgagcgcgagaaggtggacgcgatcgacggggagtaccggctccgcggcgaggcccggaagaccttcgtcgacctgatgcgccgcggggacctgcccgtgtggctcgcctaccgcgtggccgccgagggcatcaactacgcggaccggcgctggtgcttcgacgggatcaagaacaaccagatcctggaggagaacgtcgaggtggagatctggaccaaggagggcgagcggaagaagctgaagccgcgctggctcgacgcccggatctactccgaccccctggccctgaaggagttcaaggagttcgccgcgggccgcaagagcctcaccctgaacctgatcacggagatggggcggctccccaccttcatgacccagaaggcccgcgacgccctggacaacctggccgtcctccacaccgccgaggcgggcgggcgggcctacaaccacgccctgtccgagctgcccgagacgctcgagaccctgctgctcctgaccctgctcgccaccgtgacgggcggcatcttcctgttcctgatgagcgggaagggcatcgggaagatgaccctcggcatgtgctgcatcatcaccgcctccatcctgctgtggtacgcgcagatccagccgcactggatcgccgccagcatcatcctcgagttcttcctgatcgtgctgctcatccccgagcccgagaagcagcgcacgccccaggacaaccagctgacctacgtcgtgatcgccatcctgacggtggtcgccgcgaccatggccaacgagatggggttcctcgagaagaccaagaaggacctgggcctgggcagcatcaccacgcaggagtccgagagcaacatcctcgacatcgacctgcggccggcctccgcctggaccctgtacgccgtggcgaccaccttcgtgacgcccatgctccgccacagcatcgagaactccagcgtcaacgtgtccctgaccgccatcgccaaccaggccaccgtgctgatggggctcggcaaggggtggcccctgagcaagatggacatcggcgtccccctgctcgcgatcgggtgctactcccaggtgaacccgatcaccctgacggccgccctgctcctgctggtggcccactacgccatcatcggccccggcctccaggcgaaggccacccgcgaggcccagaagcgggccgccgcggggatcatgaagaaccccaccgtcgacggcatcaccgtgatcgacctggagcccatcccgtacgaccccaagttcgagaagcagctgggccaggtgatgctcctgatcctgtgcgtcacccaggtgctcatgatgcgcaccacctgggccctgtgcgaggccctgaccctcgccacgggccccatcagcaccctgtgggaggggaaccccggccggttctggaacaccaccatcgccgtgtccatggcgaacatcttccgcggcagctacctggccggggccggcctcctgttctccatcatgaagaacacgaccaacacccggcgcgggaccggcaacatcggcgagacgctgggggagaagtggaagtcccggctcaacgccctgggcaagtccgagttccagatctacaagaagtccgggatccaggaggtcgaccgcaccctggcgaaggagggcatcaagcgcggggagaccgaccaccacgccgtgtcccgcggcagcgccaagctccggtggttcgtggagcgcaacatggtcaccccggagggcaaggtggtggacctggggtgcggccgcggcgggtggtcctactactgcggcgggctgaagaacgtccgcgaggtgaaggggctcacgaagggcgggcccgggcacgaggagcccatccccatgagcacctacggctggaacctggtgcggctgcagagcggggtcgacgtgttcttcaccccgcccgagaagtgcgacaccctcctgtgcgacatcggcgagtccagccccaaccccacgatcgaggccggccgcaccctgcgggtgctcaacctggtcgagaactggctgaacaacaacacccagttctgcatcaaggtgctcaacccgtacatgccctccgtgatcgagaagatggagaccctgcagcgcaagtacgggggcgccctggtccggaaccccctgagccgcaactccacccacgagatgtactgggtgagcaacgcgacggggaacatcgtgtccagcgtcaacatgatctcccgcatgctcatcaaccggttcaccatgaagcacaagaaggccacctacgagccggacgtggacctgggcagcgggacccgcaacatcggcatcgagtccgagatccccaacctggacatcatcggcaagcggatcgagaagatcaagcaggagcacgagacgagctggcactacgaccaggaccacccctacaagacctgggcctaccacgggtcctacgagaccaagcagaccggcagcgcctccagcatggtgaacggggtcgtgcgcctcctgacgaagccctgggacgtggtcccgatggtgacccagatggccatgaccgacaccacgcccttcggccagcagcgggtgttcaaggagaaggtcgacacccgcacccaggagcccaaggagggcaccaagaagctgatgaagatcacggcggagtggctctggaaggagctggggaagaagaagacgccccggatgtgcacccgcgaggagttcacccggaaggtgcgctccaacgccgccctgggcgccatcttcacggacgagaacaagtggaagtccgcccgggaggcggtggaggactcccgcttctgggagctcatcgaccgggagcgcaacctgcacctggaggggaagtgcgagacctgcgtctacaacatgatgggcaagcgggagaagaagctcggggagttcggcaaggccaagggcagccgcgccatctggtacatgtggctgggggcccggttcctggagttcgaggcgctcggcttcctgaacgaggaccactggttcagccgcgggaactccctgagcggcgtggagggggagggcctccaccggctgggctacatcctgcgcgacgtctccaagaaggagggcggggccatgtacgccgacgacaccgccgggtgggacacccggatcacgctcgaggacctgaagaacgaggagatggtgaccaaccacatgaagggcgagcacaagaagctggccgaggcgatcttcaagctcacctaccagaacaaggtggtccgcgtgcagcgcccgacgccccgggggacggtgatggacatcatcagccgccgggaccagcgcggctccggccaggtcgggacctacggcctgaacaccttcaccaacatggaggcccagctgatccggcagatggagggggagggcatcttcaagagcatccagcacctcacggtgaccgaggagatcgccgtgcagaactggctggcccgcgtcggccgggagcgcctgtcccggatggccatcagcggggacgactgcgtggtgaagcccctcgacgaccgcttcgcgtccgccctgaccgccctgaacgacatgggcaaggtccggaaggacatccagcagtgggagcccagccgcgggtggaacgactggacccaggtgccgttctgctcccaccacttccacgagatcgtgatgaaggacggccgggtcctcgtggtgccctgccgcaaccaggacgagctgatcgggcgggcccgcatcagccagggcgccggctggtccctgaaggagacggcgtgcctcggcaagagctacgcccagatgtggaccctgatgtacttccaccggcgcgacctgcggctcgccgccaacgccatctgctccgcggtccccagccactgggtgcccacctcccgcaccacctggagcatccacgccaagcacgagtggatgacgaccgaggacatgctggccgtgtggaaccgcgtctggatccaggagaacccgtggatggaggacaagacccccgtggagagctgggaggaggtgccctacctgggcaagcgggaggaccagtggtgcgggtccctcatcggcctgaccagccgcgccacgtgggcgaagaacatccagaccgccatcaaccaggtccggtccctgatcgggaacgaggagtacaccgactacatgcccagcatgaagcgcttccggcgcgaggaggaggaggccggcgtgctctggtga

SEQ ID NO: 9389 - RNA, 9876 nt, synthetic construct
  misc_feature 1..9876: note = derived and/or modified CDS sequence (opt1) from DENV-2__EU482588__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaaggtgcccttcgagatcatggacctcgagaagcggcacgtgctggggcgcctgatcaccgtcaacccgatcgtgaccgagaaggacagccccgtgaacatcgaggcggagccgcccttcggcgactcctacatcatcatcggggtcgagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtgttcggcgcgatctacggcgccgccttcagcggggtctcctggaccatgaagatcctgatcggcgtgatcatcacgtggatcgggatgaacagccgctccaccagcctgtccgtgagcctcgtcctggtgggcgtggtcaccctgtacctcggggccatggtgcaggcggactccggctgcgtggtcagctggaagtccaaggagctgaagtgcggcagcgggatcttcgtgaccgacaacgtgcacacgtggaccgagcagtacaagttccagcccgagagcccctccaagctggccagcgccatccagaaggcccacgaggagggcatctgcgggatccggtccgtcacccgcctcgagaacctgatgtggaagcagatcacccccgagctgaaccacatcctcagcgagaacgaggtgaagctgacgatcatgaccggcgacatcaaggggatcatgcaggccggcaagcggtccctgcgcccgcagcccaccgagctcaagtacagctggaagacctggggcaaggcgaagatgctgtccacggagagccacaaccagaccttcctgatcgacgggcccgagaccgccgagtgcccgaacaccaaccgggcctggaactccctcgaggtggaggactacggcttcggggtcttcacgaccaacatctggctgaagctgcgcgagaagcaggacgtgttctgcgacagcaagctcatgtccgccgccatcaaggacaaccgggcggtgcacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagacggcggggccctggcacctgggcaagctggagatggacttcgacttctgcgaggggaccaccgtcgtggtgaccgaggactgcggcaaccggggccccagcctccgcacgaccaccgcctccgggaagctgatcaccgagtggtgctgccggagctgcacgctgcccccgctccgctaccggggcgaggacgggtgctggtacggcatggagatccgccccctgaaggagaaggaggagaacctggtcaactccctcgtgaccgccgggcacggccagatcgacaacttcagcctgggcgtgctggggatggccctcttcctggaggagatgctgcggacccgcgtcggcaccaagcacgcgatcctcctggtggccgtgtccttcgtcacgctgatcaccgggaacatgagcttccgggacctcggccgcgtgatggtgatggtcggggccaccatgaccgacgacatcggcatgggcgtgacgtacctggccctgctcgccgcgttcaaggtgcgccccaccttcgccgccgggctgctgctccggaagctgacctccaaggagctgatgatggccaccatcggcatcgccctcctgagccagtccacgatccccgagaccatcctggagctcaccgacgcgctggccctggggatgatggtcctcaagatcgtgcgcaacatggagaagtaccagctggccgtgaccatcatggccatcagctgcgtcccgaacgccgtgatcctgcagaacgcgtggaaggtctcctgcacgatcctcgccgccgtgagcgtgagccccctgctgctcaccagctcccagcagaaggccgactggatccccctggcgctgaccatcaagggcctcaaccccaccgccatcttcctgacgaccctgagccggacctccaagaagcgcagctggccgctcaacgaggccatcatggccgtcggcatggtgtccatcctggccagcagcctgctcaagaacgacatccccatgaccgggcccctggtggcgggcgggctgctcacggtctgctacgtgctgaccggccggtccgccgacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgacgatcctcatccggaccggcctgctggtcatctccggggtgttcccggtgagcatccccatcaccgcggccgcctggtacctctgggaggtcaagaagcagcgcgccggcgtgctgtgggacgtgcccagcccgccgcccgtcgggaaggccgagctggaggacggcgcgtaccggatcaagcagcgcgggatcctcggctacagccagatcggcgccggggtgtacaaggagggcaccttccacaccatgtggcacgtgacgcgcggggccgtcctgatgcaccgcggcaagcggatcgagccctcctgggccgacgtgaagaaggacctgatcagctacgggggcggctggaagctcgagggggagtggaaggagggcgaggaggtgcaggtcctggccctggagcccgggaagaacccccgcgcggtgcagaccaagcccggcctcttcaagaccaacaccgggacgatcggcgccgtgtccctggacttcagccccggcacctccgggagccccatcgtcgaccggaagggcaaggtggtggggctgtacggcaacggcgtcgtgacccgctccggggcctacgtgagcgccatcgcgcagaccgagaagtccatcgaggacaaccccgagatcgaggacgacatcttccggaagaagcgcctcacgatcatggacctgcaccccggcgccgggaagaccaagcggtacctgcccgccatcgtccgcgaggccatcaagcggggcctgcgcaccctcatcctggccccgacccgcgtggtggcggccgagatggaggaggccctgcgggggctccccatccgctaccagacgcccgccatccgggccgagcacaccggccgcgagatcgtcgacctgatgtgccacgcgaccttcaccatgcggctgctctcccccgtgcgcgtgccgaactacaacctgatcatcatggacgaggcccacttcacggaccccgccagcatcgccgcccggggctacatctccacccgcgtcgagatgggggaggcggccggcatcttcatgaccgccacgccgcccgggagccgggacccgttcccccagtccaacgcccccatcatggacgaggagcgcgagatccccgagcggagctggaactccggccacgagtgggtgacggacttcaaggggaagaccgtgtggttcgtcccgagcatcaaggcgggcaacgacatcgccgcctgcctgcgcaagaacggcaagaaggtgatccagctctcccggaagaccttcgacagcgagtacgtgaagacccgcgccaacgactgggacttcgtcgtgacgaccgacatctccgagatgggggccaacttcaaggcggagcgggtgatcgacccccgccggtgcatgaagcccgtcatcctgaccgacggcgaggagcgcgtgatcctggccgggcccatgccggtgacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacgcccgagggcatcatcccgagcatgttcgagcccgagcgcgagaaggtcgacgccatcgacggggagtaccggctccgcggcgaggcccggaagaccttcgtggacctgatgcgccgcggggacctgcccgtgtggctcgcctaccgcgtcgccgcggagggcatcaactacgccgaccggcgctggtgcttcgacgggatcaagaacaaccagatcctggaggagaacgtggaggtcgagatctggaccaaggagggcgagcggaagaagctgaagccgcgctggctcgacgcccggatctactccgaccccctggccctgaaggagttcaaggagttcgcggccggccgcaagagcctcaccctgaacctgatcacggagatggggcggctccccaccttcatgacccagaaggcccgcgacgccctggacaacctggccgtgctccacaccgcggaggccggcgggcgggcctacaaccacgccctgtccgagctgcccgagacgctcgagaccctgctgctcctgaccctgctcgccaccgtgacgggcggcatcttcctgttcctgatgagcgggaagggcatcgggaagatgaccctcggcatgtgctgcatcatcaccgcgtccatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgccatcctgacggtcgtggcggccaccatggccaacgagatggggttcctcgagaagaccaagaaggacctgggcctgggcagcatcaccacgcaggagtccgagagcaacatcctcgacatcgacctgcggccggcctccgcctggaccctgtacgcggtggccaccaccttcgtcacgcccatgctccgccacagcatcgagaactccagcgtgaacgtgtccctgaccgccatcgccaaccaggcgaccgtcctgatggggctcggcaaggggtggcccctgagcaagatggacatcggcgtgcccctgctcgccatcgggtgctactcccaggtgaacccgatcaccctgacggccgccctgctcctgctggtcgcccactacgcgatcatcggccccggcctccaggccaaggccacccgggaggcccagaagcgcgccgcggccgggatcatgaagaaccccaccgtggacggcatcaccgtgatcgacctggagcccatcccgtacgaccccaagttcgagaagcagctggggcaggtcatgctcctgatcctgtgcgtgacccaggtcctcatgatgcgcaccacctgggccctgtgcgaggccctgaccctcgccacgggccccatcagcaccctgtgggaggggaaccccggccggttctggaacaccaccatcgcggtctccatggccaacatcttccgcggcagctacctggccggggccggcctcctgttctccatcatgaagaacacgaccaacacccggcgcgggaccggcaacatcggcgagacgctgggggagaagtggaagtcccggctcaacgcgctgggcaagtccgagttccagatctacaagaagtccgggatccaggaggtggaccgcaccctggccaaggagggcatcaagcgcggggagaccgaccaccacgccgtgtcccgcggcagcgccaagctccggtggttcgtcgagcgcaacatggtgaccccggagggcaaggtggtcgacctggggtgcggccgcggcgggtggtcctactactgcggcgggctgaagaacgtgcgcgaggtgaaggggctcacgaagggcgggcccgggcacgaggagcccatccccatgagcacctacggctggaacctggtccggctgcagagcggggtggacgtgttcttcaccccgcccgagaagtgcgacaccctcctgtgcgacatcggcgagtccagccccaaccccacgatcgaggccggccgcaccctgcgggtcctcaacctggtggagaactggctgaacaacaacacccagttctgcatcaaggtgctcaacccgtacatgccctccgtcatcgagaagatggagaccctgcagcgcaagtacgggggcgcgctggtgcggaaccccctgagccgcaactccacccacgagatgtactgggtgagcaacgccacggggaacatcgtctccagcgtgaacatgatctcccggatgctcatcaaccgcttcaccatgaagcacaagaaggccacctacgagccggacgtggacctgggcagcgggacccgcaacatcggcatcgagtccgagatccccaacctggacatcatcggcaagcggatcgagaagatcaagcaggagcacgagacgagctggcactacgaccaggaccacccctacaagacctgggcctaccacgggtcctacgagaccaagcagaccggcagcgcctccagcatggtcaacggggtggtgcgcctcctgacgaagccctgggacgtcgtgccgatggtgacccagatggcgatgaccgacaccacgcccttcggccagcagcgggtcttcaaggagaaggtggacacccgcacccaggagcccaaggagggcaccaagaagctgatgaagatcacggccgagtggctctggaaggagctggggaagaagaagacgccccggatgtgcacccgcgaggagttcacccggaaggtgcgctccaacgccgccctgggcgccatcttcacggacgagaacaagtggaagtccgcgcgggaggccgtcgaggactcccgcttctgggagctcatcgaccgggagcgcaacctgcacctggaggggaagtgcgagacctgcgtgtacaacatgatgggcaagcgggagaagaagctcggggagttcggcaaggccaagggcagccgcgccatctggtacatgtggctgggggcgcggttcctggagttcgaggccctcggcttcctgaacgaggaccactggttcagccgcgggaactccctgagcggcgtcgagggggagggcctccaccggctgggctacatcctgcgcgacgtgtccaagaaggagggcggggccatgtacgccgacgacaccgccgggtgggacacccggatcacgctcgaggacctgaagaacgaggagatggtgaccaaccacatgaagggcgagcacaagaagctggcggaggccatcttcaagctcacctaccagaacaaggtcgtgcgcgtgcagcggccgacgccccgggggacggtcatggacatcatcagccgccgggaccagcgcggctccggccaggtggggacctacggcctgaacaccttcaccaacatggaggcccagctgatccggcagatggagggggagggcatcttcaagagcatccagcacctcacggtgaccgaggagatcgccgtccagaactggctggcccgcgtgggccgggagcgcctgtcccggatggcgatcagcggggacgactgcgtggtcaagcccctcgacgaccgcttcgcctccgccctgaccgccctgaacgacatgggcaaggtgcggaaggacatccagcagtgggagcccagccgcgggtggaacgactggacccaggtgccgttctgctcccaccacttccacgagctcgtcatgaaggacggccgggtgctggtggtcccctgccgcaaccaggacgagctgatcgggcgggcccgcatcagccagggcgcgggctggtccctcaaggagacggcctgcctgggcaagagctacgcccagatgtggaccctgatgtacttccaccggcgcgacctccggctggccgccaacgcgatctgctccgccgtgcccagccactgggtgcccacctcccgcaccacctggagcatccacgccaagcacgagtggatgacgaccgaggacatgctggccgtctggaaccgggtgtggatccaggagaacccgtggatggaggacaagacccccgtggagagctgggaggaggtcccctacctcggcaagcgcgaggaccagtggtgcgggtccctgatcggcctgaccagccgcgcgacgtgggccaagaacatccagaccgccatcaaccaggtgcggtccctcatcgggaacgaggagtacaccgactacatgcccagcatgaagcgcttccggcgcgaggaggaggaggccggcgtgctgtggtga

SEQ ID NO: 9390 - RNA, 9876 nt, synthetic construct
  misc_feature 1..9876: note = derived and/or modified CDS sequence (opt1) from DENV-2__EU569705__SS-prME
  source 1..9876: mol_type = other RNA
accgccggcgtcatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatgctcctggtggccgtctccttcgtgaccctgatcacggggaacatgagcttccgggacctcggccgcgtgatggtcatggtgggggccaccatgaccgacgacatcggcatgggcatcacctacctggccctgctcgcggccttcaaggtgcgccccacgttcgccgccgggctgctgctccggaagctgacctccaaggagctgatgatggccaccatcggcatcgcgctcctgagccagtccaccatccccgagacgatcctggagctcaccgacgccctggccctggggatgatggtcctcaagatcgtgcgcaacatggagaagtaccagctggccgtgaccatcatggccatcagctgcgtcccgaacgcggtgatcctgcagaacgcctggaaggtgtcctgcaccatcctcgccgccgtcagcgtgagccccctgctgctcacgagctcccagcagaaggcggactggatccccctggccctgaccatcaagggcctcaaccccaccgccatcttcctgaccacgctgagccggacctccaagaagcgcagctggccgctcaacgaggccatcatggccgtcggcatggtgtccatcctggcgagcagcctgctcaagaacgacatccccatgaccgggcccctggtggccggcgggctgctcaccgtctgctacgtgctgacgggccggtccgccgacctggagctcgagcgcgccgccgacgtgaagtgggaggaccaggcggagatcagcgggtccagccccatcctgtccatcaccatcagcgaggacggctccatgagcatcaagaacgaggaggaggagcagaccctgaccatcctcatccggacgggcctgctggtcatctccggggtgttcccggtgagcatccccatcaccgccgccgcctggtacctctgggaggtcaagaagcagcgcgccggcgtgctgtgggacgtgcccagcccgccgcccgtcgggaaggcggagctggaggacggcgcctaccggatcaagcagcgcgggatcctcggctacagccagatcggcgccggggtgtacaaggagggcaccttccacaccatgtggcacgtgacccgcggggcggtcctgatgcaccgcggcaagcggatcgagccctcctgggccgacgtgaagaaggacctgatcagctacgggggcggctggaagctcgagggggagtggaaggagggcgaggaggtgcaggtcctggcgctggagcccgggaagaacccccgcgccgtgcagacgaagcccggcctcttcaagaccaacaccgggaccatcggcgccgtgtccctggacttcagccccggcacgtccgggagccccatcgtcgaccggaagggcaaggtggtggggctgtacggcaacggcgtcgtgacccgctccggggcctacgtgagcgcgatcgcccagaccgagaagtccatcgaggacaaccccgagatcgaggacgacatcttccggaagaagcgcctcaccatcatggacctgcaccccggcgccgggaagacgaagcggtacctgcccgccatcgtccgcgaggccatcaagcggggcctgcgcaccctcatcctggcgccgacccgcgtggtggccgccgagatggaggaggccctgcgggggctccccatccgctaccagacccccgccatccgggcggagcacacgggccgcgagatcgtcgacctgatgtgccacgccaccttcaccatgcggctgctctcccccgtgcgcgtgccgaactacaacctgatcatcatggacgaggcccacttcaccgaccccgccagcatcgccgcgcggggctacatctccacgcgcgtcgagatgggggaggccgccggcatcttcatgaccgccacgccgcccgggagccgggacccgttcccccagtccaacgcgcccatcatggacgaggagcgcgagatccccgagcggagctggaactccggccacgagtgggtgaccgacttcaaggggaagacggtgtggttcgtcccgagcatcaaggccggcaacgacatcgccgcctgcctgcgcaagaacggcaagaaggtgatccagctctcccggaagaccttcgacagcgagtacgtgaagacccgcgccaacgactgggacttcgtcgtgaccacggacatctccgagatgggggcgaacttcaaggccgagcgggtgatcgacccccgccggtgcatgaagcccgtcatcctgaccgacggcgaggagcgcgtgatcctggccgggcccatgccggtgacccacagctccgccgcccagcggcgcggccgcatcgggcggaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgcgagaaggtcgacgccatcgacggggagtaccggctccgcggcgaggcccggaagacgttcgtggacctgatgcgccgcggggacctgcccgtgtggctcgcctaccgcgtcgcggccgagggcatcaactacgccgaccggcgctggtgcttcgacgggatcaagaacaaccagatcctggaggagaacgtggaggtggagatctggaccaaggagggcgagcggaagaagctgaagccgcgctggctcgacgcccggatctactccgaccccctggcgctgaaggagttcaaggagttcgccgccggccgcaagagcctcaccctgaacctgatcaccgagatggggcggctccccacgttcatgacccagaaggcccgcgacgccctggacaacctggcggtcctccacaccgccgaggccggcgggcgggcctacaaccacgccctgtccgagctgcccgagaccctcgagacgctgctgctcctgaccctgctcgcgaccgtgaccggcggcatcttcctgttcctgatgagcgggaagggcatcgggaagatgacgctcggcatgtgctgcatcatcaccgcctccatcctgctgtggtacgcccagatccagccgcactggatcgccgccagcatcatcctcgagttcttcctgatcgtcctgctcatccccgagcccgagaagcagcgcacgccccaggacaaccagctgacctacgtggtgatcgcgatcctgaccgtcgtggccgccacgatggccaacgagatggggttcctcgagaagaccaagaaggacctgggcctgggcagcatcgccacccaggagtccgagagcaacatcctcgacatcgacctgcggccggcgtccgcctggaccctgtacgccgtggccacgaccttcgtcacccccatgctccgccacagcatcgagaactccagcgtgaacgtgtccctgaccgcgatcgccaaccaggccacggtcctgatggggctcggcaaggggtggcccctgagcaagatggacatcggcgtgcccctgctcgccatcgggtgctactcccaggtgaacccgatcaccctgaccgccgcgctgctcctgctggtcgcccactacgccatcatcggccccggcctccaggccaaggccacccgggaggcgcagaagcgcgccgccgccgggatcatgaagaaccccacggtggacggcatcaccgtgatcgacctggagcccatcccgtacgaccccaagttcgagaagcagctggggcaggtcatgctcctgatcctgtgcgtgacccaggtgctcatgatgcgcaccacgtgggccctgtgcgaggcgctgaccctcgccaccggccccatcagcaccctgtgggaggggaaccccggccggttctggaacacgaccatcgccgtctccatggccaacatcttccgcggcagctacctggcgggggccggcctcctgttctccatcatgaagaacaccaccaacacgcggcgcgggaccggcaacatcggcgagaccctgggggagaagtggaagtcccggctcaacgccctgggcaagtccgagttccagatctacaagaagtccgggatccaggaggtggaccgcaccctggccaaggagggcatcaagcgcggggagacggaccaccacgccgtgtcccgcggcagcgcgaagctccggtggttcgtcgagcgcaacatggtgaccccggagggcaaggtggtcgacctggggtgcggccgcggcgggtggtcctactactgcggcgggctgaagaacgtgcgcgaggtgaaggggctcaccaagggcggccccgggcacgaggagcccatccccatgagcacctacggctggaacctggtccggctgcagagcggggtggacgtgttcttcacgccgcccgagaagtgcgacaccctcctgtgcgacatcggcgagtccagccccaaccccaccatcgaggccggccgcaccctgcgggtcctcaacctggtggagaactggctgaacaacaacacgcagttctgcatcaaggtgctcaacccgtacatgccctccgtcatcgagaagatggagaccctgcagcgcaagtacgggggcgccctggtgcggaaccccctgagccgcaactccacccacgagatgtactgggtgagcaacgccaccgggaacatcgtctccagcgtgaacatgatctcccggatgctcatcaaccgcttcaccatgaagcacaagaaggccacgtacgagccggacgtggacctgggcagcgggacccgcaacatcgtcatcgagtccgagatccccaacctggacatcatcggcaagcggatcgagaagatcaagcaggagcacgagaccagctggcactacgaccaggaccacccctacaagacctgggcgtaccacggctcctacgagacgaagcagaccgggagcgcctccagcatggtgaacggcgtggtccgcctcctgaccaagccctgggacgtggtgccgatggtcacccagatggccatgacggacaccacccccttcgggcagcagcgggtgttcaaggagaaggtggacacccgcacgcaggagcccaaggagggcaccaagaagctgatgaagatcaccgccgagtggctctggaaggagctgggcaagaagaagacgccccggatgtgcacgcgcgaggagttcacccggaaggtccgctccaacgccgcgctgggggccatcttcaccgacgagaacaagtggaagtccgcccgggaggccgtggaggactcccgcttctgggagctcatcgaccgggagcgcaacctgcacctggagggcaagtgcgagacctgcgtgtacaacatgatggggaagcgggagaagaagctcggcgagttcgggaaggcgaagggcagccgcgccatctggtacatgtggctgggcgcccggttcctggagttcgaggccctcgggttcctgaacgaggaccactggttcagccgcggcaactccctgagcggggtcgagggcgaggggctccaccggctgggctacatcctgcgcgacgtgtccaagaaggagggcggggccatgtacgcggacgacacggccggctgggacacccggatcaccctcgaggacctgaagaacgaggagatggtcaccaaccacatgaagggggagcacaagaagctggccgaggccatcttcaagctcacgtaccagaacaaggtggtgcgcgtccagcggccgacgccccggggcaccgtgatggacatcatcagccgccgggaccagcgcgggtccggccaggtgggcacctacgggctgaacacgttcaccaacatggaggcccagctgatccggcagatggagggcgaggggatcttcaagagcatccagcacctcaccgtcaccgaggagatcgcggtgcagaactggctggcccgcgtgggccgggagcgcctgtcccggatggccatcagcggcgacgactgcgtcgtgaagcccctcgacgaccgcttcgcctccgccctgacggcgctgaacgacatggggaaggtgcggaaggacatccagcagtgggagcccagccgcggctggaacgactggacccaggtcccgttctgctcccaccacttccacgagctcgtgatgaaggacgggcgggtgctggtcgtgccctgccgcaaccaggacgagctgatcggccgggcccgcatcagccagggggccggctggtccctcaaggagaccgcctgcctgggcaagagctacgcccagatgtggaccctgatgtacttccaccggcgcgacctccggctggcggccaacgccatctgctccgccgtgcccagccactgggtccccacgtcccgcaccacctggagcatccacgcgaagcacgagtggatgaccaccgaggacatgctggccgtgtggaaccgggtgtggatccaggagaacccgtggatggaggacaagacgcccgtcgagagctgggaggaggtgccctacctcgggaagcgcgaggaccagtggtgcggctccctgatcgggctgaccagccgcgccacctgggccaagaacatccagaccgccatcaaccaggtgcggtccctcatcggcaacgaggagtacacggactacatgcccagcatgaagcgcttccggcgcgaggaggaggaggcgggggtcctgtggtga

SEQ ID NO: 9391 - RNA, 9876 nt, synthetic construct
  misc_feature 1..9876: note = derived and/or modified CDS sequence (opt1) from DENV-2__EU482589__SS-prME
  source 1..9876: mol_type = other RNA
accgccggcgtgatcatcatgctgatccccaccgccatggcgttccacctcaccacccggaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacgtggatcctgcggcacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggatgggcctggacttcaacgagatggtcctgctccagatggaggacaaggcctggctggtgcaccggcagtggttcctggacctccccctgccctggctgccgggggccgacacccagggcagcaactggatccagaaggagaccctcgtgacgttcaagaacccccacgcgaagaagcaggacgtcgtggtcctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtgaaggagatcgccgagacccagcacgggaccatcgtgatccgcgtccagtacgagggcgacggctccccctgcaagatccccttcgagatcatggacctcgagaagcggcacgtgctggggcgcctgatcacggtgaacccgatcgtcaccgagaaggacagccccgtgaacatcgaggcggagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggccatggtccaggcggactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggccggcaagcggtccctgcgcccgcagcccaccgagctcaagtacagctggaagacctggggcaaggcgaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgccatcaaggacaaccgggcggtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacctggccgggcccgtgagccagcacaactaccgcccgggctaccacacccagaccgcggggccctggcacctgggcaagctcgagatggacttcgacttctgcgaggggacgaccgtggtggtcaccgaggactgcggcaaccggggccccagcctgcgcaccacgaccgcctccgggaagctggtgaccgagtggtgctgccggagctgcaccctcccgcccctgcgctaccggggcgaggacgggtgctggtacggcatggagatccgccccctgaaggagaaggaggagaacctcgtgaactccctggtcacggccgggcacggccagatcgacaacttcagcctgggcgtgctcgggatggccctgttcctggaggagatgctccggacccgcgtgggcaccaagcacgcgatcctgctggtcgccgtgtccttcgtgaccctcatcacggggaacatgagcttccgggacctgggccgcgtcatggtgatggtgggggccaccatgaccgacgacatcggcatgggcgtcacctacctggccctcctggccgcgttcaaggtgcgccccacgttcgccgccgggctgctcctgcggaagctgacctccaaggagctcatgatggccaccatcggcatcgccctgctgagccagtccaccatccccgagacgatcctcgagctgaccgacgcgctggccctcgggatgatggtgctgaagatcgtccgcaacatggagaagtaccagctggccgtgaccatcatggccatcagctgcgtgcccaacgccgtcatcctccagaacgcgtggaaggtgtcctgcaccatcctggccgccgtcagcgtgagccccctgctcctgacgagctcccagcagaaggccgactggatccccctggcgctcaccatcaagggcctgaaccccaccgccatcttcctgaccacgctcagccggacctccaagaagcgcagctggccgctgaacgaggccatcatggccgtgggcatggtctccatcctggccagcagcctcctgaagaacgacatccccatgaccgggcccctggtggcgggcgggctcctgaccgtgtgctacgtcctgacgggccggtccgccgacctcgagctggagcgcgccgccgacgtgaagtgggaggaccaggccgagatcagcgggtccagccccatcctgtccatcaccatcagcgaggacggctccatgagcatcaagaacgaggaggaggagcagaccctcaccatcctgatccggacgggcctgctcgtgatctccggggtcttcccggtgagcatccccatcaccgcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcctgggctacagccagatcggcgccggggtctacaaggagggcaccttccacaccatgtggcacgtgacccgcggggccgtgctgatgcaccgcggcaagcggatcgagccctcctgggccgacgtcaagaaggacctcatcagctacgggggcggctggaagctggagggggagtggaaggagggcgaggaggtccaggtgctggccctcgagcccgggaagaacccccgcgcggtccagacgaagcccggcctgttcaagaccaacaccgggaccatcggcgccgtgtccctggacttcagccccggcacgtccgggagccccatcgtggaccggaagggcaaggtcgtggggctctacggcaacggcgtggtcacccgctccggggcctacgtgagcgccatcgcgcagaccgagaagtccatcgaggacaaccccgagatcgaggacgacatcttccggaagaagcgcctgaccatcatggacctgcaccccggcgccgggaagacgaagcggtacctgcccgccatcgtgcgcgaggccatcaagcggggcctccgcaccctgatcctggccccgacccgcgtcgtggcggccgagatggaggaggccctccgggggctgcccatccgctaccagacccccgccatccgggccgagcacacgggccgcgagatcgtggacctgatgtgccacgcgaccttcaccatgcggctcctgtcccccgtccgcgtgccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggcgggcaacgacatcgccgcctgcctccgcaagaacggcaagaaggtcatccagctgtcccggaagaccttcgacagcgagtacgtgaagacccgcgccaacgactgggacttcgtggtcaccacggacatctccgagatgggggccaacttcaaggcggagcgggtgatcgacccccgccggtgcatgaagcccgtgatcctgaccgacggcgaggagcgcgtcatcctcgccgggcccatgccggtgacccacagctccgccgcccagcggcgcggccgcatcgggcggaaccccaagaacgagaacgaccagtacatctacatgggcgagcccctggagaacgacgaggactgcgcccactggaaggaggcgaagatgctgctcgacaacatcaacacccccgagggcatcatcccgagcatgttcgagcccgagcgcgagaaggtggacgccatcgacggggagtaccggctgcgcggcgaggcccggaagacgttcgtcgacctgatgcgccgcggggacctccccgtgtggctggcctaccgcgtggccgcggagggcatcaactacgccgaccggcgctggtgcttcgacgggatcaagaacaaccagatcctggaggagaacgtcgaggtggagatctggaccaaggagggcgagcggaagaagctcaagccgcgctggctggacgcccggatctactccgaccccctggccctcaaggagttcaaggagttcgcggccggccgcaagagcctgaccctgaacctcatcaccgagatggggcggctgcccacgttcatgacccagaaggcccgcaacgccctggacaacctcgccgtcctgcacaccgcggaggccggcgggcgggcctacaaccacgccctgtccgagctccccgagaccctggagacgctgctcctgctgaccctcctggccaccgtgaccggcggcatcttcctgttcctcatgagcgggaagggcatcgggaagatgacgctgggcatgtgctgcatcatcaccgcgtccatcctgctctggtacgcccagatccagccgcactggatcgccgccagcatcatcctggagttcttcctgatcgtgctcctgatccccgagcccgagaagcagcgcacgccccaggacaaccagctgacctacgtcgtgatcgccatcctcaccgtggtcgcggccacgatggccaacgagatggggttcctggagaagaccaagaaggacctgggcctcggcagcatcaccacccaggagtccgagagcaacatcctggacatcgacctgcggccggcctccgcctggacgctctacgcggtggccaccaccttcgtgacccccatgctgcgccacagcatcgagaactccagcgtcaacgtgtccctgacggccatcgccaaccaggcgaccgtgctcatggggctgggcaaggggtggcccctgagcaagatggacatcggcgtccccctcctggccatcgggtgctactcccaggtgaacccgatcaccctgaccgccgccctcctgctgctcgtggcccactacgcgatcatcggccccggcctgcaggccaaggccacgcgggaggcccagaagcgcgccgcggccgggatcatgaagaaccccaccgtcgacggcatcaccgtgatcgacctggagcccatcccgtacgaccccaagttcgagaagcagctcggccaggtgatgctgctgatcctctgcgtcacccaggtgctgatgatgcgcacgacctgggccctgtgcgaggccctcaccctggccaccggccccatcagcacgctgtgggaggggaaccccggccggttctggaacaccaccatcgcggtgtccatggccaacatcttccgcggcagctacctcgccggggccggcctgctgttctccatcatgaagaacaccacgaacacccggcgcgggaccggcaacatcggcgagaccctcggggagaagtggaagtcccggctgaacgcgctgggcaagagcgagttccagatctacaagaagtccgggatccaggaggtcgaccgcacgctcgccaaggagggcatcaagcgcggggagaccgaccaccacgccgtgtcccgcggcagcgccaagctgcggtggttcgtggagcgcaacatggtcaccccggagggcaaggtggtggacctggggtgcggccgcggcgggtggtcctactactgcggcgggctcaagaacgtccgcgaggtgaaggggctgaccaagggcgggcccgggcacgaggagcccatccccatgagcacgtacggctggaacctggtgcggctccagagcggggtcgacgtgttcttcaccccgcccgagaagtgcgacaccctgctgtgcgacatcggcgagtccagccccaaccccaccatcgaggccggccgcacgctccgggtgctgaacctggtcgagaactggctcaacaacaacacccagttctgcatcaaggtgctgaacccgtacatgccctccgtgatcgagaagatggagaccctgcagcgcaagtacgggggcgcgctggtccggaaccccctcagccgcaactccacccacgagatgtactgggtgagcaacgccaccgggaacatcgtgtccagcgtcaacatgatctcccggatgctgatcaaccgcttcacgatgaagcacaagaaggccacctacgagccggacgtggacctgggcagcgggacccgcaacatcggcatcgagtccgagatccccaacctcgacatcatcggcaagcggatcgagaagatcaagcaggagcacgagaccagctggcactacgaccaggaccacccctacaagacgtgggcctaccacgggtcctacgagaccaagcagaccggcagcgcctccagcatggtgaacggggtcgtgcgcctgctgaccaagccctgggacgtggtcccgatggtgacgcagatggcgatgaccgacaccacccccttcggccagcagcgggtgttcaaggagaaggtcgacacgcgcacccaggagcccaaggagggcaccaagaagctcatgaagatcaccgccgagtggctgtggaaggagctggggaaggagaagacgccccggatgtgcacccgcgaggagttcacccggaaggtgcgctccaacgccgccctcggcgccatcttcaccgacgagaacaagtggaagtccgcgcgggaggccgtggaggactcccgcttctgggagctgatcgaccgggagcgcaacctgcacctcgaggggaagtgcgagacgtgcgtctacaacatgatgggcaagcgggagaagaagctgggggagttcggcaaggccaagggcagccgcgccatctggtacatgtggctgggggcgcggttcctcgagttcgaggccctgggcttcctgaacgaggaccactggttcagccgcgagaactccctcagcggggtggagggcgaggggctgcaccggctgggctacatcctccgcgacgtctccaagaaggagggcggggccatgtacgccgacgacaccgccggctgggacacccggatcaccctggaggacctgaagaacgaggagatggtgacgaaccacatgaagggggagcacaagaagctcgcggaggccatcttcaagctgacctaccagaacaaggtggtccgcgtgcagcggccgacgccccgcggcaccgtgatggacatcatcagccgccgggaccagcgcgggtccggccaggtcggcacctacgggctgaacaccttcaccaacatggaggcccagctcatccggcagatggagggcgaggggatcttcaagagcatccagcacctgaccgccacggaggagatcgccgtgcagaactggctggcgcgcgtgggccgggagcgcctctcccggatggccatcagcggcgacgactgcgtcgtgaagcccctggacgaccgcttcgcctccgccctgaccgccctcaacgacatggggaaggtgcggaaggacatccagcagtgggagcccagccgcggctggaacgactggacccaggtcccgttctgctcccaccacttccacgagctggtgatgaaggacgggcgggtgctggtcgtgccctgccgcaaccaggacgagctcatcggccgggcgcgcatcagccagggggccggctggtccctgaaggagaccgcctgcctgggcaagagctacgcccagatgtggacgctcatgtacttccaccggcgcgacctgcggctggccgcgaacgccatctgctccgccgtgcccagccactgggtccccacctcccgcaccacctggagcatccacgccaagcacgagtggatgaccacggaggacatgctcgcggtgtggaaccgggtgtggatccaggagaacccgtggatggaggacaagacccccgtcgagagctgggaggaggtgccctacctggggaagcgcgaggaccagtggtgcggctccctgatcgggctcaccagccgcgccacctgggccaagaacatccagacggccatcaaccaggtgcggtccctgatcggcaacgaggagtacaccgactacatgcccagcatgaagcgcttccggcgcgaggaggaggaggccggggtcctgtggtga

SEQ ID NO: 9392 - RNA, 9876 nt, synthetic construct
  misc_feature 1..9876: note = derived and/or modified CDS sequence (opt1) from DENV-2__EU569706__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtggcggagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggtgatggtccaggcggactccggctgcgtggtgagctggaagaacaaggagctgaagtgcggctccgggatcttcatcaccgacaacgtccacacctggacggagcagtacaagttccagcccgagagccccagcaagctggcctccgccatccagaaggcccacgaggagggcatctgcgggatccggagcgtgacccgcctcgagaacctgatgtggaagcagatcacccccgagctgaaccacatcctctccgagaacgaggtgaagctgaccatcatgacgggcgacatcaaggggatcatgcaggccggcaagcggagcctgcgcccgcagcccaccgagctcaagtactcctggaagacctggggcaaggcgaagatgctgagcaccgagtcccacaaccagacgttcctgatcgacgggcccgagaccgccgagtgcccgaacaccaaccgggcctggaacagcctcgaggtcgaggactacggcttcggggtgttctccaccaacatctggctgaagctgcgcgagaagcaggacgtgttctgcgacagcaagctcatgtccgccgccatcaaggacaaccgggcggtccacgccgacatgggctactggatcgagagcgccctgaacgacacgtggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgcggggccctggcacctgggcaagctggagatggacttcgacttctgcgaggggaccacggtggtggtcaccgaggactgcggcaaccggggccccagcctccgcaccaccacggcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacgcgcgtgggcaccaagcacgcgatcctcctggtggccgtctccttcgtgaccctgatcaccgggaacatgagcttccgggacctcggccgcgtgatggtcatggtgggggccacgatgaccgacgacatcggcatgggcgtgacctacctggccctgctcgccgcgttcaaggtccgccccaccttcgccgccgggctgctgctccggaagctgacgtccaaggagctgatgatggccaccatcggcatcgccctcctgagccagtccaccatccccgagaccatcctggagctcacggacgcgctggccctggggatgatggtgctcaagatcgtgcgcaacctggagaagtaccagctggccgtcaccatcatggccatcagctgcgtgccgaacgccgtgatcctccagaacgcgtggaaggtctcctgcaccatcctggccgccgtgagcgtcagccccctgctcctgaccagctcccagcagaaggccgactggatccccctggcgctcacgatcaagggcctgaaccccaccgccatcttcctgaccaccctcagccggacgtccaagaagcgcagctggccgctgaacgaggccgtgatggccgtgggcatggtctccatcctggccagcagcctcctgaagaacgacatccccatgaccgggcccctggtggcgggcgggctcctgaccgtgtgctacgtcctgaccggccggtccgccgacctcgagctggagcgcgccgccgacgtgaagtgggaggaccaggccgagatcagcgggtccagccccatcctgtccatcacgatcagcgaggacggctccatgagcatcaagaacgaggaggaggagcagaccctcaccatcctgatccggaccggcctgctcgtgatctccggggtcttcccggtgagcatccccatcacggcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcttcggctacagccagatcggcgccggggtctacaaggagggcaccttccacaccatgtggcacgtgacccgcggggccgtgctgatgcaccgcggcaagcggatcgagccctcctgggccgacgtcaagaaggacctgatcagctacgggggcggctggaagctcgagggggagtggaaggagggcgaggaggtccaggtgctggccctggagcccgggaagaacccccgcgcggtccagaccaagcccggcctcttcaagacgaacaccgggaccatcggcgccgtgtccctggacttcagccccggcacctccgggagccccatcgtggaccggaagggcaaggtcgtggggctgtacggcaacggcgtggtcacgcgctccggggcctacgtgagcgccatcgcgcagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggccccgacccgcgtcgtggcggccgagatggaggaggccctgcgggggctccccatccgctaccagacccccgccatccgggccgagcacaccggccgcgagatcgtggacctgatgtgccacgcgacgttcaccatgcggctgctctcccccgtccgcgtgccgaactacaacctgatcatcatggacgaggcccacttcaccgaccccgccagcatcgccgcccggggctacatctccacccgcgtggagatgggggaggcggccggcatcttcatgacggccacgccgcccgggagccgggacccgttcccccagtccaacgcccccatcatggacgaggagcgcgagatccccgagcggagctggaactccggccacgagtgggtcaccgacttcaaggggaagaccgtgtggttcgtgccgagcatcaaggcgggcaacgacatcgccgcctgcctgcgcaagaacggcaagaaggtcatccagctctcccggaagacgttcgacagcgagtacgtgaagacccgcgccaacgactgggacttcgtggtcaccaccgacatctccgagatgggggccaacttccgggcggagcgcgtgatcgacccccggcgctgcatgaagcccgtgatcctgacggacggcgaggagcgggtcatcctggccgggcccatgccggtgacccacagctccgccgcccagcgccgcggccggatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtggacgccatcgacggggagtaccgcctccggggcgaggcccgcaagaccttcgtcgacctgatgcggcgcggggacctgcccgtgtggctcgcctaccgggtggccgcggagggcatcaactacgccgaccgccggtggtgcttcgacgggatcaagaacaaccagatcctggaggagaacgtcgaggtggagatctggacgaaggagggcgagcgcaagaagctgaagccgcggtggctcgacgcccgcatctactccgaccccctggccctgaaggagttcaaggagttcgcggccggccggaagtccctcaccctgaacctgatcaccgagatggggcgcctccccaccttcatgacgcagaaggcccgggacgccctggacaacctggccgtcctccacaccgcggaggtgggcgggcgcgcctacaaccacgccctgtccgagctgcccgagaccctcgagaccctgctgctcctgacgctgctcgccaccgtgaccggcggcatcttcctgttcctgatgagcgggaagggcatcgggaagatgaccctcggcatgtgctgcatcatcacggcctccatcctgctgtggtacgcgcagatccagccgcactggatcgccgccagcatcatcctcgagttcttcctgatcgtcctgctcatccccgagcccgagaagcagcggacgccccaggacaaccagctgacctacgtggtgatcgccatcctgaccgtcgtggccgcgaccatggccaacgagatggggttcctcgagaagacgaagaaggacctgggcctgggcagcatcaccacccaggagtccgagagcaacatcctcgacatcgacctgcgcccggcctccgcctggaccctgtacgccgtggcgacgaccttcgtcacccccatgctccggcacagcatcgagaactccagcgtgaacgtgtccctgaccgccatcgccaaccaggccacggtcctgatggggctcggccgcgggtggcccctgagcaagatggacatcggcgtgcccctgctcgcgatcgggtgctactcccaggtgaacccgatcaccctgaccgccgccctgctcctgctggtcgcccactacgccatcatcggccccggcctccaggcgaaggccacccgcgaggcccagaagcgggccgccgcggggatcatgaagaaccccacggtggacggcatcaccgtgatcgacctggagcccatcccgtacgaccccaagttcgagaagcagctggggcaggtcatgctcctggtgctgtgcgtgacccaggtcctcatgatgcgcaccacgtgggccctgtgcgaggccctgaccctcgccaccggccccatcagcaccctgtgggaggggaaccccggccggttctggaacacgaccatcgccgtgtccatggcgaacatcttccgcggcagctacctggccggggccggcctcctgttctccatcatgaagaacaccaccaacacgcggcgcgggaccggcaacatcggcgagaccctgggggagaagtggaagtcccggctcaacgccctgggcaagtccgagttccagatctacaagaagtccgggatccaggaggtggaccgcaccctggcgaaggagggcatcaagcgcggggagacggaccaccacgccgtctcccgcggcagcgccaagctccggtggttcgtggagcgcaacatggtgaccccggagggcaaggtcgtggacctggggtgcggccgcggcgggtggtcctactactgcggcgggctgaagaacgtgcgcgaggtcaaggggctcaccaagggcgggcccgggcacgaggagcccatccccatgagcacctacggctggaacctggtgcggctgcagagcggggtggacgtcttcttcacgccgcccgagaagtgcgacaccctcctgtgcgacatcggcgagtccagccccaaccccaccatcgaggccggccgcaccctgcgggtgctcaacctggtggagaactggctgaacaacaacacgcagttctgcatcaaggtcctcaacccgtacatgccctccgtgatcgagaagatggagaccctgcagcgcaagtacgggggcgccctggtgcggaaccccctgagccgcaactccacccacgagatgtactgggtcagcaacgcgaccgggaacatcgtgtccagcgtgaacatgatctcccgcatgctcatcaaccggttcaccatgaagcacaagaaggccacgtacgagccggacgtcgacctgggcagcgggacccgcaacatcggcatcgagaacgagatccccaacctggacatcatcggcaagcggatcgagaagatcaagcaggagcacgagacctcctggcactacgaccaggaccacccctacaagacctgggcctaccacgggagctacgagacgaagcagaccggctccgccagctccatggtgaacggggtggtccgcctcctgaccaagccctgggacgtggtgccgatggtcacccagatggccatgacggacaccacccccttcggccagcagcgggtgttcaaggagaaggtggacacccgcacgcaggagcccaaggagggcaccaagaagctgatgcggatcaccgcggagtggctctggaaggagctggggaagaagaagacgccccggatgtgcacgcgggaggagttcacccgcaaggtccggagcaacgccgccctgggcgccatcttcaccgacgagaacaagtggaagtccgcccgcgaggcggtggaggacagccggttctgggagctcgtcgaccgcgagcggaacctgcacctggaggggaagtgcgagacctgcgtgtacaacatgatgggcaagcgcgagaagaagctcggggagttcggcaaggccaagggctcccgggccatctggtacatgtggctgggggcccgcttcctggagttcgaggcgctcggcttcctgaacgaggaccactggttcagccgggggaacagcctgtccggcgtggagggggagggcctccacaagctgggctacatcctgcgcgacgtcagcaagaaggagggcggcgccatgtacgccgacgacacggccgggtgggacacccggatcaccctcgaggacctgaagaacgaggagatggtgaccaaccacatgaagggcgagcacaagaagctggccgaggcgatcttcaagctcacgtaccagaacaaggtggtccgcgtgcagcgcccgacgccccgggggaccgtgatggacatcatctcccgcaaggaccagcggggcagcggccaggtcgggacctacggcctgaacacgttcaccaacatggaggcccagctgatccgccagatggagggggagggcatcttcaagtccatccagcacctcaccgtgaccgaggagatcgccgtgcagaactggctggcccgggtcggccgcgagcggctgagccgcatggccatctccggggacgactgcgtggtgaagcccctcgacgaccggttcgcgagcgccctgacggccctgaacgacatgggcaaggtccgcaaggacatccagcagtgggagccctcccgggggtggaacgactggacccaggtgccgttctgcagccaccacttccacgagctcgtgatgaaggacggccgcgtcctggtggtgccctgccggaaccaggacgagctgatcgggcgcgcccggatctcccagggcgccggctggagcctcaaggagaccgcgtgcctggggaagtcctacgcccagatgtggaccctgatgtacttccaccgccgggacctccgcctggccgccaacgccatctgcagcgcggtcccctcccactgggtgcccacgagccggaccacctggtccatccacgccaagcacgagtggatgaccaccgaggacatgctggccgtgtggaaccgcgtctggatccaggagaacccgtggatggaggacaagacgcccgtggagagctgggaggaggtgccctacctcggcaagcgcgaggaccagtggtgcgggagcctgatcggcctgacctcccgggccacctgggcgaagaacatccagaccgccatcaaccaggtccgcagcctcatcgggaacgaggagtacacggactacatgccctccatgaagcggttccgcaaggaggaggaggaggccggcgtgctgtggtga

SEQ ID NO: 9393 - RNA, 9876 nt, synthetic construct
  misc_feature 1..9876: note = derived and/or modified CDS sequence (opt1) from DENV-2__EU569707__SS-prME
  source 1..9876: mol_type = other RNA
accgcgggggtgatcatcatgctgatccccaccgccatggcgttccacctcaccacccgcaacggggagccccacatgatcgtcgggcggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcgtggaggccaagctgacgaacaccaccaccgagtcccggtgcccgacgcagggcgagcccagcctgaacgaggagcaggacaagcgcttcgtgtgcaagcactccatggtcgaccggggctgggggaacggctgcggcctcttcggcaagggcgggatcgtgacctgcgcgatgttcacgtgcaagaagaacatggagggcaaggtggtcctgcccgagaacctggagtacaccatcgtgatcacgccccacagcggggaggagcacgccgtgggcaacgacaccgggaagcacggcaaggagatcaagatcaccccgcagtccagcatcaccgaggccgagctcaccgggtacggcacggtcaccatggagtgcagcccccgcaccggcctggacttcaacgagatggtgctgctccggatggaggacaaggcctggctggtgcaccgccagtggttcctggacctccccctgccctggctgccgggggccgacacccagggcagcaactggatccagaaggagacgctcgtcaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccggctccgcatggacaagctgcagctgaaggggatgtcctacagcatgtgcaccggcaagttcaagatcgtgaaggagatcgccgagacccagcacgggacgatcgtcatccgggtgcagtacgagggcgacggctccccctgcaagatccccttcgagatcatggacctcgagaagcgccacgtgctggggcgcctgatcaccgtcaacccgatcgtggcggagaaggacagccccgtgaacatcgaggccgagccgcccttcggcgactcctacatcatcatcggggtcgagccgggccagctcaagctgaactggttcaagaaggggagctccatcggccagatgttcgagaccaccatgcggggcgccaagcgcatggccatcctgggggacacggcctgggacttcggcagcctcgggggcgtgttcacctccatcgggaaggcgctgcaccaggtgttcggcgccatctacggcgccgccttcagcggggtctcctggaccatgaagatcctgatcggcgtgatcatcacctggatcgggatgaacagccggtccacgagcctgtccgtgagcctcgtcctggtgggcgtggtcaccctgtacctcggggcgatggtgcaggccgactccggctgcgtggtcagctggaagtccaaggagctgaagtgcggcagcgggatcttcatcaccgacaacgtgcacacctggacggagcagtacaagttccagcccgagagcccctccaagctggccagcgccatccagaaggcccacgaggagggcatctgcgggatccgctccgtgacccggctcgagaacctgatgtggaagcagatcacccccgagctgaaccacatcctcagcgagaacgaggtcaagctgaccatcatgacgggcgacatcaaggggatcatgcaggcgggcaagcgctccctgcggccgcagcccaccgagctcaagtacagctggaagacctggggcaaggccaagatgctgtccaccgagagccacaaccagacgttcctgatcgacgggcccgagaccgccgagtgcccgaacaccaaccgcgcctggaactccctcgaggtggaggactacggcttcggggtgttcaccacgaacatctggctgaagctgcgggagaagcaggacgtcttctgcgacagcaagctcatgtccgccgcgatcaaggacaaccgcgccgtgcacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccggccgggctaccacacccagaccgccgggccctggcacctgggcaagctggagatggacttcgacttctgcgaggggacgaccgtggtcgtgaccgaggactgcggcaaccgcggccccagcctccggaccacgaccgcctccgggaagctgatcaccgagtggtgctgccgcagctgcaccctgcccccgctccggtaccgcggcgaggacgggtgctggtacggcatggagatccggcccctgaaggagaaggaggagaacctggtgaactccctcgtcacggccgggcacggccagatcgacaacttcagcctgggcgtgctggggatggccctcttcctggaggagatgctgcgcacccgggtgggcaccaagcacgccatgctcctggtcgccgtgtccttcgtgaccctgatcacggggaacatgagcttccgcgacctcggccgcgtcatggtgatggtgggggccaccatgaccgacgacatcggcatgggcatcacctacctggccctgctcgcggccttcaaggtccggcccacgttcgccgccgggctgctgctccgcaagctgacctccaaggagctgatgatggccaccatcggcatcgcgctcctgagccagtccaccatccccgagacgatcctggagctcaccgacgccctggccctggggatgatggtgctcaagatcgtgcggaacatggagaagtaccagctggccgtcaccatcatggccatcagctgcgtgccgaacgcggtgatcctgcagaacgcctggaaggtctcctgcaccatcctcgccgccgtgagcgtcagccccctgctgctcacgagctcccagcagaaggcggactggatccccctggccctgaccatcaagggcctcaaccccaccgccatcttcctgaccacgctgagccgcacctccaagaagcggagctggccgctcaacgaggccatcatggccgtgggcatggtgtccatcctggcgagcagcctgctcaagaacgacatccccatgaccgggcccctggtcgccggcgggctgctcaccgtgtgctacgtgctgacgggccgctccgccgacctggagctcgagcgggccgccgacgtcaagtgggaggaccaggcggagatcagcgggtccagccccatcctgtccatcaccatcagcgaggacggctccatgagcatcaagaacgaggaggaggagcagaccctgaccatcctcatccgcacgggcctgctggtgatctccggggtgttcccggtcagcatccccatcaccgccgccgcctggtacctctgggaggtgaagaagcagcgggccggcgtgctgtgggacgtccccagcccgccgcccgtggggaaggcggagctggaggacggcgcctaccgcatcaagcagcgggggatcctcggctacagccagatcggcgccggggtgtacaaggagggcaccttccacaccatgtggcacgtcacccgcggggccgtgctgatgcaccggggcaagcgcatcgagccctcctgggccgacgtgaagaaggacctgatcagctacgggggcggctggaagctcgagggggagtggaaggagggcgaggaggtccaggtgctggcgctggagcccgggaagaacccccgggccgtgcagacgaagcccggcctcttcaagaccaacaccgggaccatcggcgccgtctccctggacttcagccccggcacgtccgggagccccatcgtggaccgcaagggcaaggtggtcgggctgtacggcaacggcgtggtgacccggtccggggcctacgtcagcgcgatcgcccagaccgagaagtccatcgaggacaaccccgagatcgaggacgacatcttccgcaagaagcggctcaccatcatggacctgcaccccggcgccgggaagacgaagcgctacctgcccgccatcgtgcgggaggccatcaagcgcggcctgcgcaccctcatcctggcgccgacccgggtggtcgccgccgagatggaggaggccctgcgcgggctccccatccggtaccagacccccgccatccgcgcggagcacacgggccgggagatcgtggacctgatgtgccacgccaccttcaccatgcgcctgctctcccccgtgcgggtcccgaactacaacctgatcatcatggacgaggcccacttcaccgaccccgccagcatcgccgcgcgcggctacatctccacgcgggtggagatgggggaggccgccggcatcttcatgaccgccacgccgcccgggagccgcgacccgttcccccagtccaacgcgcccatcatggacgaggagcgggagatccccgagcgcagctggaactccggccacgagtgggtgaccgacttcaaggggaagacggtctggttcgtgccgagcatcaaggccggcaacgacatcgccgcctgcctgcggaagaacggcaagaaggtgatccagctctcccgcaagaccttcgacagcgagtacgtcaagacccgggccaacgactgggacttcgtggtgaccacggacatctccgagatgggggcgaacttcaaggccgagcgcgtcatcgacccccggcgctgcatgaagcccgtgatcctgaccgacggcgaggagcgggtgatcctggccgggcccatgccggtcacccacagctccgccgcccagcgccgcggccggatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgggagaaggtggacgccatcgacggggagtaccgcctccggggcgaggcccgcaagacgttcgtggacctgatgcggcgcggggacctgcccgtctggctcgcctaccgggtggcggccgagggcatcaactacgccgaccgccggtggtgcttcgacgggatcaagaacaaccagatcctggaggagaacgtggaggtcgagatctggaccaaggagggcgagcgcaagaagctgaagccgcggtggctcgacgcccgcatctactccgaccccctggcgctgaaggagttcaaggagttcgccgccggccggaagtccctcaccctgaacctgatcaccgagatggggcgcctccccacgttcatgacccagaaggcccgggacgccctggacaacctggcggtgctccacaccgccgaggccggcgggcgcgcctacaaccacgccctgtccgagctgcccgagaccctcgagacgctgctgctcctgaccctgctcgcgaccgtcaccggcggcatcttcctgttcctgatgagcgggaagggcatcgggaagatgacgctcggcatgtgctgcatcatcaccgcctccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgcgatcctgaccgtggtggccgccacgatggccaacgagatggggttcctcgagaagaccaagaaggacctgggcctgggcagcatcgccacccaggagtccgagagcaacatcctcgacatcgacctgcgcccggcgtccgcctggaccctgtacgccgtcgccacgaccttcgtgacccccatgctccggcacagcatcgagaactccagcgtgaacgtctccctgaccgcgatcgccaaccaggccacggtgctgatggggctcggcaaggggtggcccctgagcaagatggacatcggcgtgcccctgctcgccatcgggtgctactcccaggtcaacccgatcaccctgaccgccgcgctgctcctgctggtggcccactacgccatcatcggccccggcctccaggccaaggccacccgcgaggcgcagaagcgcgccgccgccgggatcatgaagaaccccacggtggacggcatcaccgtcatcgacctggagcccatcccgtacgaccccaagttcgagaagcagctgggccaggtgatgctcctgatcctgtgcgtgacccaggtcctcatgatgcggaccacgtgggccctgtgcgaggcgctgaccctcgccaccggccccatcagcaccctgtgggaggggaaccccggccgcttctggaacacgaccatcgccgtgtccatggccaacatcttccggggcagctacctggcgggggccggcctcctgttctccatcatgaagaacaccaccaacacgcgccgggggaccggcaacatcggcgagaccctgggggagaagtggaagtcccgcctcaacgccctgggcaagtccgagttccagatctacaagaagtccgggatccaggaggtggaccggaccctggccaaggagggcatcaagcgcggggagacggaccaccacgccgtctcccggggcagcgcgaagctccgctggttcgtggagcggaacatggtgaccccggagggcaaggtcgtggacctggggtgcggccgcgggggctggtcctactactgcgggggcctgaagaacgtgcgggaggtcaagggcctcaccaagggcgggcccgggcacgaggagcccatccccatgagcacctacggctggaacctggtgcgcctgcagagcggggtggacgtcttcttcacgccgcccgagaagtgcgacaccctcctgtgcgacatcggcgagtccagccccaaccccaccatcgaggccggccggaccctgcgcgtgctcaacctggtggagaactggctgaacaacaacacgcagttctgcatcaaggtcctcaacccgtacatgccctccgtgatcgagaagatggagaccctgcagcggaagtacgggggcgccctggtgcgcaaccccctgagccggaactccacccacgagatgtactgggtcagcaacgccaccgggaacatcgtgtccagcgtgaacatgatctcccgcatgctcatcaaccgcttcaccatgaagcacaagaaggccacgtacgagccggacgtcgacctgggcagcgggacccggaacatcggcatcgagtccgagatccccaacctggacatcatcggcaagcgcatcgagaagatcaagcaggagcacgagaccagctggcactacgaccaggaccacccctacaagacctgggcgtaccacgggtcctacgagacgaagcagaccggcagcgcctccagcatggtgaacggggtggtccggctcctgaccaagccctgggacgtggtgccgatggtcacccagatggccatgacggacaccacccccttcggccagcagcgcgtgttcaaggagaaggtggacacccggacgcaggagcccaaggagggcaccaagaagctgatgaagatcaccgccgagtggctctggaaggagctggggaagaagaagacgccccgcatgtgcacgcgggaggagttcacccgcaaggtccggtccaacgccgcgctgggcgccatcttcaccgacgagaacaagtggaagtccgcccgcgaggccgtggaggactcccggttctgggagctcatcgaccgcgagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttcagccgggggaactccctgagcggcgtcgagggggagggcctccaccgcctgggctacatcctgcgggacgtgtccaagaaggagggcggggccatgtacgcggacgacacggccgggtgggacacccgcatcaccctcgaggacctgaagaacgaggagatggtcaccaaccacatgaagggcgagcacaagaagctggccgaggccatcttcaagctcacgtaccagaacaaggtggtgcgggtccagcgcccgacgccccgcgggaccgtgatggacatcatcagccggcgcgaccagcggggctccggccaggtggggacctacggcctgaacacgttcaccaacatggaggcccagctgatccgccagatggagggggagggcatcttcaagagcatccagcacctcaccgtcaccgaggagatcgcggtgcagaactggctggcccgggtgggccgcgagcggctgtcccgcatggccatcagcggggacgactgcgtcgtgaagcccctcgacgaccggttcgcctccgccctgacggcgctgaacgacatgggcaaggtgcgcaaggacatccagcagtgggagcccagccgggggtggaacgactggacccaggtcccgttctgctcccaccacttccacgagctcgtgatgaaggacggccgcgtgctggtcgtgccctgccggaaccaggacgagctgatcgggcgcgcccggatcagccagggcgccggctggtccctcaaggagaccgcctgcctgggcaagagctacgcccagatgtggaccctgatgtacttccaccgccgggacctccgcctggcggccaacgccatctgctccgccgtgcccagccactgggtccccacgtcccggaccacctggagcatccacgcgaagcacgagtggatgaccaccgaggacatgctggccgtgtggaaccgcgtgtggatccaggagaacccgtggatggaggacaagacgcccgtcgagagctgggaggaggtgccctacctcggcaagcgcgaggaccagtggtgcgggtccctgatcggcctgaccagccgggccacctgggccaagaacatccagaccgccatcaaccaggtgcgctccctcatcgggaacgaggagtacacggactacatgcccagcatgaagcggttccgccgggaggaggaggaggcgggcgtcctgtggtga

SEQ ID NO: 9394 - RNA, 9876 nt, synthetic construct
  misc_feature 1..9876: note = derived and/or modified CDS sequence (opt1) from DENV-2__EU660399__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcgtgtgcaagcactccatggtggaccggggctgggggaacggctgcggcctcttcggcaagggcgggatcgtgacctgcgcgatgttcacgtgcaagaagaacatggagggcaaggtggtgctgcccgagaacctggagtacaccatcgtcatcacgccccacagcggggaggagcacgccgtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgcgaagaagcaggacgtcgtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcgcggagaaggacagccccgtgaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtcttcacctccatcgggaaggcgctgcaccaggtgttcggcgccatctacggcgccgccttcagcggggtgtcctggaccatgaagatcctgatcggcgtcatcatcacctggatcgggatgaacagccgctccacgagcctgtccgtgagcctcgtgctggtcggcgtggtgaccctgtacctcggggcgatggtccaggccgactccggctgcgtggtgagctggaagtccaaggagctgaagtgcggcagcgggatcttcatcaccgacaacgtccacacctggacggagcagtacaagttccagcccgagagcccctccaagctggccagcgccatccagaaggcccacgaggagggcatctgcgggatccggtccgtgacccgcctcgagaacctgatgtggaagcagatcacccccgagctgaaccacatcctcagcgagaacgaggtgaagctgaccatcatgacgggcgacatcaaggggatcatgcaggcgggcaagcggtccctgcgcccgcagcccaccgagctcaagtacagctggaagacctggggcaaggccaagatgctgtccaccgagagccacaaccagacgttcctgatcgacgggcccgagaccgccgagtgcccgaacaccaaccgggcctggaactccctcgaggtcgaggactacggcttcggggtgttcaccacgaacatctggctgaagctgcgcgagaagcaggacgtgttctgcgacagcaagctcatgtccgccgcgatcaaggacaaccgggccgtccacgccgacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgcggggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcctccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatgctcctggtggccgtctccttcgtgaccctgatcacggggaacatgagcttccgggacctcggccgcgtgatggtcatggtgggggccaccatgaccgacgacatcggcatgggcatcacctacctggccctgctcgcggccttcaaggtgcgccccacgttcgccgccgggctgctgctccggaagctgacctccaaggagctgatgatggccaccatcggcatcgcgctcctgagccagtccaccatccccgagacgatcctggagctcaccgacgccctggccctggggatgatggtcctcaagatcgtgcgcaacatggagaagtaccagctggccgtgaccatcatggccatcagctgcgtcccgaacgcggtgatcctgcagaacgcctggaaggtgtcctgcaccatcctcgccgccgtcagcgtgagccccctgctgctcacgagctcccagcagaaggcggactggatccccctggccctgaccatcaagggcctcaaccccaccgccatcttcctgaccacgctgagccggacctccaagaagcgcagctggccgctcaacgaggccgtcatggccgtgggcatggtgtccatcctggcgagcagcctgctcaagaacgacatccccatgaccgggcccctggtcgccggcgggctgctcaccgtgtgctacgtgctgacgggccggtccgccgacctggagctcgagcgcgccgccgacgtcaagtgggaggaccaggcggagatcagcgggtccagccccatcctgtccatcaccatcagcgaggacggctccatgagcatcaagaacgaggaggaggagcagaccctgaccatcctcatccggacgggcctgctggtgatctccggggtgttcccggtcagcatccccatcaccgccgccgcctggtacctctgggaggtgaagaagcagcgcgccggcgtgctgtgggacgtccccagcccgccgcccgtggggaaggcggagctggaggacggcgcctaccggatcaagcagcgcgggatcctcggctacagccagatcggcgccggggtgtacaaggagggcaccttccacaccatgtggcacgtcacccgcggggcggtgctgatgcaccgcggcaagcggatcgagccctcctgggccgacgtgaagaaggacctgatcagctacgggggcggctggaagctcgagggggagtggaaggagggcgaggaggtccaggtgctggcgctggagcccgggaagaacccccgcgccgtgcagacgaagcccggcctcttcaagaccaacaccgggaccatcggcgccgtctccctggacttcagccccggcacgtccgggagccccatcgtggaccggcagggcaaggtggtcgggctgtacggcaacggcgtggtgacccgctccggggcctacgtcagcgcgatcgcccagaccgagaagtccatcgaggacaaccccgagatcgaggacgacatcttccggaagaagcgcctcaccatcatggacctgcaccccggcgccgggaagacgaagaagtacctgcccgccatcgtgcgggaggccatcaagcgcggcctgcggaccctcatcctggcgccgacccgcgtggtcgccgccgagatggaggaggccctgcgcgggctccccatccggtaccagacccccgccatccgcgcggagcacacgggccgggagatcgtggacctgatgtgccacgccaccttcaccatgcgcctgctctcccccgtgcgggtcccgaactacaacctgatcatcatggacgaggcccacttcaccgaccccgccagcatcgccgcgcgcggctacatctccacgcgggtggagatgggggaggccgccggcatcttcatgaccgccacgccgcccgggagccgcgacccgttcccccagtccaacgcgcccatcatggacgaggagcgggagatccccgagcgcagctggaactccggccacgagtgggtgaccgacttcaaggggaagacggtctggttcgtgccgagcatcaaggccggcaacgacatcgccgcctgcctgcggaagaacggcaagaaggtgatccagctctcccgcaagaccttcgacagcgagtacgtcaagacccgggccaacgactgggacttcgtggtgaccacggacatctccgagatgggggcgaacttcaaggccgagcgcgtcatcgacccccggcgctgcatgaagcccgtgatcctgaccgacggcgaggagcgggtgatcctggccgggcccatgccggtcacccacagctccgccgcccagcgccggggccgcatcgggcgcaaccccaagaacgagaacgaccagtacatctacatgggcgagcccctcgagaacgacgaggactgcgcgcactggaaggaggccaagatgctgctggacaacatcaacacccccgagggcatcatcccgagcatgttcgagcccgagcgggagaaggtggacgccatcgacggggagtaccgcctccggggcgaggcccgcaagacgttcgtggacctgatgcggcgcggggacctgcccgtctggctcgcctaccgggtggcggccgagggcatcaactacgccgaccgccggtggtgcttcgacgggatcaagaacaaccagatcctggaggagaacgtggaggtcgagatctggaccaaggagggcgagcgcaagaagctgaagccgcggtggctcgacgcccgcatctactccgaccccctggcgctgaaggagttcaaggagttcgccgccggccggaagtccctcaccctgaacctgatcaccgagatggggcgcctccccacgttcatgacccagaaggcccgggacgccctggacaacctggcggtgctccacaccgccgaggccggcgggcgcgcctacaaccacgccctgtccgagctgcccgagaccctcgagacgctgctgctcctgaccctgctcgcgaccgtcaccggcggcatcttcctgttcctgatgagcgggaagggcatcgggaagatgacgctcggcatgtgctgcatcatcaccgcctccatcctgctgtggtacgcccagatccagccgcactggatcgccgccagcatcatcctcgagttcttcctgatcgtgctgctcatccccgagcccgagaagcagcggacgccccaggacaaccagctgacctacgtggtcatcgcgatcctgaccgtggtggccgccacgatggccaacgagatggggttcctcgagaagaccaagaaggacctgggcctgggcagcatcgccacccaggagtccgagagcaacatcctcgacatcgacctgcgcccggcgtccgcctggaccctgtacgccgtcgccacgaccttcgtgacccccatgctccggcacagcatcgagaactccagcgtgaacgtctccctgaccgcgatcgccaaccaggccacggtgctgatggggctcggcaaggggtggcccctgagcaagatggacatcggcgtgcccctgctcgccatcgggtgctactcccaggtcaacccgatcaccctgaccgccgcgctgctcctgctggtggcccactacgccatcatcggccccggcctccaggccaaggccacccgcgaggcgcagaagcgggccgccgccgggatcatgaagaaccccacggtggacggcatcaccgtcatcgacctggagcccatcccgtacgaccccaagttcgagaagcagctggggcaggtcatgctcctgatcctgtgcgtgacccaggtcctcatgatgcgcaccacgtgggccctgtgcgaggcgctgaccctcgccaccggccccatcagcaccctgtgggaggggaaccccggccgcttctggaacacgaccatcgccgtgtccatggccaacatcttccggggcagctacctggcgggggccggcctcctgttctccatcatgaagaacaccaccaacacgcgccgggggaccggcaacatcggcgagaccctgggggagaagtggaagtcccgcctcaacgccctgggcaagtccgagttccagatctacaagaagtccgggatccaggaggtggaccggaccctggccaaggagggcatcaagcgcggggagacggaccaccacgccgtctcccggggcagcgcgaagctccgctggttcgtggagcggaacatggtgaccccggagggcaaggtcgtggacctggggtgcggccgcgggggctggtcctactactgcgggggcctgaagaacgtgcgggaggtcaagggcctcaccaagggcgggcccgggcacgaggagcccatccccatgagcacctacggctggaacctggtgcgcctgcagagcggggtggacgtcttcttcacgccgcccgagaagtgcgacaccctcctgtgcgacatcggcgagtccagccccaaccccaccatcgaggccggccggaccctgcgcgtgctcaacctggtggagaactggctgaacaacaacacgcagttctgcatcaaggtcctcaacccgtacatgccctccgtgatcgagaagatggagaccctgcagcggaagtacgggggcgccctggtgcgcaaccccctgagccggaactccacccacgagatgtactgggtcagcaacgccaccgggaacatcgtgtccagcgtgaacatgatctcccgcatgctcatcaaccggttcaccatgaagcacaagaaggccacgtacgagccggacgtcgacctgggcagcgggacccgcaacatcggcatcgagtccgagatccccaacctggacatcatcggcaagcgcatcgagaagatcaagcaggagcacgagaccagctggcactacgaccaggaccacccctacaagacctgggcgtaccacgggtcctacgagacgaagcagaccggcagcgcctccagcatggtgaacggggtggtccggctcctgaccaagccctgggacgtggtgccgatggtcacccagatggccatgacggacaccacccccttcggccagcagcgcgtgttcaaggagaaggtggacacccggacgcaggagcccaaggagggcaccaagaagctgatgaagatcaccgccgagtggctctggaaggagctggggaagaagaagacgccccgcatgtgcacgcgggaggagttcacccgcaaggtccggtccaacgccgcgctgggcgccatcttcaccgacgagaacaagtggaagtccgcccgcgaggccgtggaggactcccggttctgggagctcatcgaccgcgagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttcagccgggggaactccctgagcggcgtcgagggggagggcctccaccgcctgggctacatcctgcgggacgtgtccaagaaggagggcggggccatgtacgcggacgacacggccgggtgggacacccgcatcaccctcgaggacctgaagaacgaggagatggtcaccaaccacatgaagggcgagcacaagaagctggccgaggccatcttcaagctcacgtaccagaacaaggtggtgcgggtccagcgcccgacgccccgggggaccgtgatggacatcatcagccgccgcgaccagcggggctccggccaggtggggacctacggcctgaacacgttcaccaacatggaggcccagctgatccgccagatggagggggagggcatcttcaagagcatccagcacctcaccgtcaccgaggagatcgcggtgcagaactggctggcccgggtgggccgcgagcggctgtcccgcatggccatcagcggggacgactgcgtcgtgaagcccctcgacgaccggttcgcctccgccctgacggcgctgaacgacatgggcaaggtgcgcaaggacatccagcagtgggagcccagccgggggtggaacgactggacccaggtcccgttctgctcccaccacttccacgagctcgtgatgaaggacggccgcgtgctggtcgtgccctgccggaaccaggacgagctgatcgggcgcgcccggatcagccagggcgccggctggtccctcaaggagaccgcctgcctgggcaagagctacgcccagatgtggaccctgatgtacttccaccgccgggacctccgcctggcggccaacgccatctgctccgccgtgcccagccactgggtccccacgtcccggaccacctggagcatccacgcgaagcacgagtggatgaccaccgaggacatgctggccgtgtggaaccgcgtgtggatccaggagaacccgtggatggaggacaagacgcccgtcgagagctgggaggaggtgccctacctcggcaagcgggaggaccagtggtgcgggtccctgatcggcctgaccagccgcgccacctgggccaagaacatccagaccgccatcaaccaggtgcgctccctcatcgggaacgaggagtacacggactacatgcccagcatgaagcggttccgccgggaggaggaggaggcgggcgtcctgtggtga

SEQ ID NO: 9395 - RNA, 9876 nt, synthetic construct
  misc_feature 1..9876: note = derived and/or modified CDS sequence (opt1) from DENV-2__EU569708__SS-prME
  source 1..9876: mol_type = other RNA
accgccggggtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcgccatcatggcggccatcctggcctacaccatcgggaccacccacttccagcgggccctcatcttcatcctgctgaccgcggtggcccccagcatgaccatgcgctgcatcggcatctccaaccgggacttcgtggagggcgtcagcgggggctcctgggtggacatcgtgctcgagcacgggagctgcgtcaccaccatggccaagaacaagcccacgctggacttcgagctgatcaagaccgaggccaagcagcccgccaccctccgcaagtactgcatcgaggcgaagctgaccaacacgaccaccgagtcccggtgcccgacccagggcgagcccagcctgaacgaggagcaggacaagcgcttcatctgcaagcactccatggtggaccggggctgggggaacggctgcggcctcttcggcaagggcgggatcgtgacgtgcgccatgttcacgtgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggagaaggcctggctggtccaccggcagtggttcctggacctccccctgccctggctgccgggggcggacacccagggcagcaactggatccagaaggagaccctcgtgacgttcaagaacccccacgccaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgcggagacccagcacgggaccatcgtgatccgcgtgcagtacgagggcgacggctccccctgcaagatccccttcgagatcatggacctcgagaagcggcacgtcctggggcgcctgatcacggtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggcgctgcaccaggtcttcggcgccatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggcgatggtgcaggccgactccggctgcgtcgtgagctggaagaacaaggagctgaagtgcggctccgggatcttcatcaccgacaacgtgcacacctggacggagcagtacaagttccagcccgagagccccagcaagctggcctccgccatccagaaggcccacgaggagggcatctgcgggatccggagcgtcacccgcctcgagaacctgatgtggaagcagatcacccccgagctgaaccacatcctctccgagaacgaggtgaagctgaccatcatcacgggcgacatcaaggggatcatgcaggcgggcaagcggagcctgcgcccgcagcccaccgagctcaagtactcctggaagacctggggcaaggccaagatgctgagcaccgagtcccacaaccagacgttcctgatcgacgggcccgagaccgccgagtgcccgaacaccaaccgggcctggaacagcctcgaggtggaggactacggcttcggggtcttcaccacgaacatctggctgaagctgcgcgagaagcaggacgtgttctgcgactccaagctcatgagcgccgcgatcaaggacaaccgggccgtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgcggggcccgtgtcccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgccatcctcctggtggccgtgagcttcgtcaccctgatcacggggaacatgtccttccgggacctcggccgcgtgatggtgatggtcggggccaccatgaccgacgacatcggcatgggcgtgacctacctggccctgctcgcggccttcaaggtgcgccccacgttcgccgccgggctgctgctccggaagctgaccagcaaggagctgatgatggccaccatcggcatcgcgctcctgtcccagagcaccatccccgagacgatcctggagctcaccgacgccctggccctggggatgatggtcctcaagatcgtgcgcaacatggagaagtaccagctggccgtgaccatcatggccatctcctgcgtcccgaacgcggtgatcctgctcaacgcctggaaggtgagctgcaccatcctggccgccgtctccgtgagccccctgctcctgacgtccagccagcagaagaccgactggatccccctggcgctcaccatcaagggcctgaaccccaccgccatcttcctgacgaccctctcccggaccagcaagaagcgctcctggccgctgaacgaggccgtcatggccgtgggcatggtgagcatcctggcctccagcctcctgaagaacgacatccccatgaccgggcccctggtcgcgggcgggctcctgacggtgtgctacgtgctgaccggccggagcgccgacctcgagctggagcgcgccgccgacgtcaagtgggaggaccaggccgagatctccgggagctcccccatcctgagcgtgaccatctccgaggacggcagcatgtccatcaagaacgaggaggaggagcagaccctcacgatcctgatccggaccggcctgctcgtgatcagcggggtcttcccggtgtccatccccatcaccgcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcctgggctactcccagatcggcgccggggtctacaaggagggcaccttccacaccatgtggcacgtgacgcgcggggcggtgctgatgcaccgcggcaagcggatcgagcccagctgggccgacgtcaagaaggacctcatctcctacgggggcggctggaagctggagggggagtggaaggagggcgaggaggtccaggtgctggccctcgagcccgggaagaacccccgcgcggtccagaccaagcccggcctgttcaagaccaacaccgggacgatcggcgccgtgagcctggacttctcccccggcaccagcgggtcccccatcgtggaccggaagggcaaggtcgtggggctctacggcaacggcgtggtcacccgcagcggggcctacgtgtccgccatcgcgcagaccgagaagtccatcgaggacaaccccgagatcgaggacgacatcttccggaagaagcgcctgacgatcatggacctgcaccccggcgccgggaagaccaagcggtacctgcccgccatcgtgcgcgaggccatcaagcggggcctccgcaccctgatcctggccccgacccgcgtcgtggcggccgagatggaggaggccctccgggggctgcccatccgctaccagacgcccgccatccgggccgagcacaccggccgcgagatcgtggacctgatgtgccacgcgaccttcaccatgcggctcctgagccccgtccgcgtgccgaactacaacctgatcatcatggacgaggcccacttcacggaccccgcctccatcgccgcccggggctacatcagcacccgcgtggagatgggggaggcggccggcatcttcatgaccgccacgccgcccgggtcccgggacccgttcccccagagcaacgcccccatcatggacgaggagcgcgagatccccgagcggtcctggaacagcggccacgagtgggtcacggacttcaaggggaagaccgtgtggttcgtgccgtccatcaaggcgggcaacgacatcgccgcctgcctccgcaagaacggcaagaaggtcatccagctgagccggaagaccttcgactccgagtacgtgaagacccgcgccaacgactgggacttcgtggtcacgaccgacatcagcgagatgggggccaacttccgggcggagcgcgtgatcgacccccggcgctgcatgaagcccgtgatcctgaccgacggcgaggagcgggtcatcctcgccgggcccatgccggtgacccactccagcgccgcccagcgccgcggccggatcgggcgcaaccccaagaacgagaacgaccagtacatctacatgggcgagcccctggagaacgacgaggactgcgcccactggaaggaggcgaagatgctgctcgacaacatcaacacgcccgagggcatcatcccgtccatgttcgagcccgagcgggagaaggtggacgccatcgacggggagtaccgcctgcggggcgaggcccgcaagaccttcgtcgacctgatgcggcgcggggacctccccgtgtggctggcctaccgggtggccgcggagggcatcaactacgccgaccgccggtggtgcttcgacgggatcaagaacaaccagatcctggaggagaacgtcgaggtggagatctggaccaaggagggcgagcgcaagaagctcaagccgcggtggctggacgcccgcatctacagcgaccccctggccctcaaggagttcaaggagttcgcggccggccggaagtccctgaccctgaacctcatcacggagatggggcgcctgcccaccttcatgacccagaaggcccgggacgccctggacaacctcgccgtcctgcacaccgcggaggccggcgggcgcgcctacaaccacgccctgagcgagctccccgagacgctggagaccctgctcctgctgaccctcctggccaccgtgacgggcggcatcttcctgttcctcatgtccgggaagggcatcgggaagatgaccctgggcatgtgctgcatcatcaccgcgagcatcctgctctggtacgcccagatccagccgcactggatcgccgcctccatcatcctggagttcttcctgatcgtgctcctgatccccgagcccgagaagcagcggacgccccaggacaaccagctgacctacgtcgtgatcgccatcctcacggtggtcgcggccaccatggccaacgagatggggttcctggagaagaccaagaaggacctgggcctcggcagcatcaccacgcaggagagcgagtccaacatcctggacatcgacctgcgcccggccagcgcctggaccctctacgcggtggccaccaccttcgtgacgcccatgctgcggcactccatcgagaacagctccgtcaacgtgagcctgaccgccatcgccaaccaggcgaccgtgctcatggggctgggcaaggggtggcccctgtccaagatggacatcggcgtccccctcctggccatcgggtgctacagccaggtgaacccgatcaccctgacggccgccctcctgctgctcgtggcccactacgcgatcatcggccccggcctgcaggccaaggccacccgcgaggcccagaagcgcgccgcggccgggatcatgaagaaccccaccgtcgacggcatcaccgtgatcgacctggagcccatcccgtacgaccccaagttcgagaagcagctcggccaggtgatgctgctgatcctctgcgtcacccaggtgctgatgatgcggaccacctgggccctgtgcgaggccctcaccctggccacgggccccatctccaccctgtgggaggggaaccccggccgcttctggaacaccaccatcgcggtgagcatggccaacatcttccggggctcctacctcgccggggccggcctgctgttcagcatcatgaagaacacgaccaacacccgccgggggaccggcaacatcggcgagacgctcggggagaagtggaagtcccgcctgaacgcgctgggcaagagcgagttccagatctacaagaagtccgggatccaggaggtcgaccggaccctcgccaaggagggcatcaagcgcggggagaccgaccaccacgccgtgagccggggctccgccaagctgcgctggttcgtggagcggaacatggtcaccccggagggcaaggtggtggacctggggtgcggccgcgggggctggagctactactgcgggggcctcaagaacgtccgggaggtgaagggcctgacgaagggcgggcccgggcacgaggagcccatccccatgtccacctacggctggaacctggtgcgcctccagagcggggtcgacgtgttcttcaccccgcccgagaagtgcgacaccctgctgtgcgacatcggcgagagctcccccaaccccacgatcgaggccggccggaccctccgcgtgctgaacctggtcgagaactggctcaacaacaacacccagttctgcatcaaggtgctgaacccgtacatgcccagcgtgatcgagaagatggagaccctgcagcggaagtacgggggcgcgctggtccgcaaccccctctcccggaacagcacccacgagatgtactgggtgtccaacgccacggggaacatcgtgagctccgtcaacatgatcagccgcatgctgatcaaccgcttcaccatgaagcacaagaaggccacctacgagccggacgtggacctgggctccgggacccggaacatcggcatcgagagcgagatccccaacctcgacatcatcggcaagcgcatcgagcggatcaagcaggagcacgagacgtcctggcactacgaccaggaccacccctacaagacctgggcctaccacgggagctacgagaccaagcagaccggctccgccagctccatggtgaacggggtcgtgcgcctgctgacgaagccctgggacgtggtcccgatggtgacccagatggcgatgaccgacaccacgcccttcggccagcagcgggtgttcaaggagaaggtcgacacccgcacccaggagcccaaggagggcaccaagaagctcatgcggatcacggccgagtggctgtggaaggagctggggaagaagaagacgccccgcatgtgcacccgggaggagttcacccgcaaggtgcggagcaacgccgccctcggcgccgtgttcacggacgagaacaagtggaagtccgcgcgcgaggccgtcgaggacagccggttctgggagctggtggaccgcgagcggaacctgcacctcgaggggaagtgcgagacctgcgtctacaacatgatgggcaagcgcgagaagaagctgggggagttcggcaaggccaagggctcccgggccatctggtacatgtggctgggggcgcgcttcctcgagttcgaggccctgggcttcctgaacgaggaccactggttcagccggcgcaacagcctctccggggtggagggcgaggggctgcaccggctgggctacatcctccgcgacgtgagcaagaaggagggcggggccatgtacgccgacgacaccgccggctgggacacccgcatcacgctggaggacctgaagaacgaggagatggtcaccaaccacatgaagggggagcacaagaagctcgcggaggccatcttcaagctgacctaccagaacaaggtggtgcgggtccagcgcccgacgccccggggcacggtgatggacatcatctcccgccgggaccagcgcgggagcggccaggtgggcacctacgggctgaacaccttcaccaacatggaggcccagctcatccggcagatggagggcgaggggatcttcaagtccatccagcacctgacggtcaccgaggagatcgccgtgcagaactggctggcccgcgtgggccgggagcgcctcagccggatggcgatctccggcgacgactgcgtcgtgaagcccctggacgaccgcttcgccagcgccctgaccgccctcaacgacatggggaaggtgcggaaggacatccagcagtgggagccctcccgcggctggaacgactggacccaggtcccgttctgcagccaccacttccacgagctggtgatgaaggacgggcgggtgctggtcgtgccctgccgcaaccaggacgagctcatcggccgggcccgcatctcccagggggcgggctggagcctgaaggagacggcctgcctgggcaagtcctacgcccagatgtggaccctcatgtacttccaccggcgcgacctgcgcctggccgccaacgcgatctgcagcgccgtgccctcccactgggtccccaccagccggaccacctggtccatccacgccaagcacgagtggatgacgaccgaggacatgctcgccgtgtggaaccgcgtgtggatccaggagaacccgtggatggaggacaagacccccgtcgagagctgggaggaggtgccctacctggggaagcgggaggaccagtggtgcggcagcctgatcgggctcacctcccgcgcgacgtgggccaagaacatccagaccgccatcaaccaggtgcggagcctgatcggcaacgaggagtacaccgactacatgccctccatgaagcgcttccggcgcgaggaggaggaggccggggtcctgtggtga

SEQ ID NO: 9396 - RNA, 9876 nt, synthetic construct
  misc_feature 1..9876: note = derived and/or modified CDS sequence (opt1) from DENV-2__EU569709__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggtacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcctgtgcgtgccgaacgccgtgatcctccagaacgcctggaaggtcagctgcaccatcctggcggccgtgtccgtcagccccctgctcctgacgtccagccagcagaaggccgactggatccccctggccctcaccatcaagggcctgaaccccaccgcgatcttcctgaccacgctctcccggaccagcaagaagcgctcctggccgctgaacgaggccgtgatggccgtgggcatggtcagcatcctggcctccagcctcctgaagaacgacatccccatgaccgggcccctggtggccggcgggctcctgaccgtgtgctacgtcctgacgggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagaccctcaccatcctgatccggacgggcctgctcgtgatcagcggggtcttcccggtgtccatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctactcccagatcggcgcgggggtctacaaggagggcaccttccacaccatgtggcacgtgacccgcggggccgtgctgatgcaccgcggcaagcggatcgagcccagctgggccgacgtcaagaaggacctgatctcctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgcggtgagcctggacttctcccccggcacgagcgggtcccccatcgtggaccggaagggcaaggtcgtggggctgtacggcaacggcgtggtcacccgcagcggggcctacgtgtccgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtcgtggccgcggagatggaggaggccctgcgggggctccccatccgctaccagacccccgccatccgggccgagcacacgggccgcgagatcgtggacctgatgtgccacgccaccttcaccatgcggctgctcagccccgtccgcgtgccgaactacaacctgatcatcatggacgaggcgcacttcaccgaccccgcctccatcgccgcccggggctacatcagcacgcgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtcaccgacttcaaggggaagacggtgtggttcgtgccgtccatcaaggccggcaacgacatcgcggcctgcctgcgcaagaacggcaagaaggtcatccagctcagccggaagaccttcgactccgagtacgtgaagacccgcgccaacgactgggacttcgtggtcaccacggacatcagcgagatgggggccaacttccgggccgagcgcgtgatcgacccccggcgctgcatgaagcccgtgatcctgaccgacggcgaggagcgggtcatcctggcggggcccatgccggtgacccactccagcgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtggacgcgatcgacggggagtaccgcctccggggcgaggcccgcaagacgttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggaccaaggagggcgagcgcaagaagctgaagccgcggtggctcgacgcccgcatctacagcgaccccctggccctgaaggagttcaaggagttcgccgcgggccggaagtccctcaccctgaacctgatcaccgagatggggcgcctccccacgttcatgacccagaaggcccgggacgccctggacaacctggccgtcctccacaccgccgaggtgggcgggcgcgcgtacaaccacgccctgagcgagctgcccgagaccctcgagacgctgctgctcctgaccctgctcgccaccgtgaccggcggcatcttcctgttcctgatgtccgggaagggcatcgggaagatgacgctcggcatgtgctgcatcatcaccgccagcatcctgctgtggtacgcccagatccagccgcactggatcgcggcctccatcatcctcgagttcttcctgatcgtcctgctcatccccgagcccgagaagcagcggacgccccaggacaaccagctgacctacgtggtgatcgccatcctgaccgtcgtggccgccacgatggcgaacgagatggggttcctcgagaagaccaagaaggacctgggcctgggcagcatcatcacccaggagagcgagtccaacatcctcgacatcgacctgcgcccggccagcgcctggaccctgtacgccgtggccacgaccttcgtcacccccatgctccggcactccatcgagaacagctccgtgaacgtgagcctgaccgcgatcgccaaccaggccacggtcctgatggggctcggccgcgggtggcccctgtccaagatggacatcggcgtgcccctgctcgccatcgggtgctacagccaggtgaacccgatcaccctgaccgcggccctgctcctgctggtcgcccactacgccatcatcggccccggcctccaggccaaggcgacccgcgaggcccagaagcgggccgccgccgggatcatgaagaaccccacggtggacggcatcaccgtgatcgacctggagcccatcccgtacgaccccaagttcgagaagcagctggggcaggtcatgctcctggtgctgtgcgtgacccaggtcctcatgatgcgcaccacgtgggcgctgtgcgaggccctgaccctcgccaccggccccatctccaccctgtgggaggggaaccccggccggttctggaacacgaccatcgccgtgagcatggccaacatcttccgcggctcctacctggcgggggccggcctcctgttcagcatcatgaagaacaccaccaacacgcggcgcgggaccggcaacatcggcgagaccctgggggagaagtggaagtcccggctcaacgccctgggcaagagcgagttccagatctacaagaagtccgggatccaggaggtggaccgcaccctggccaaggagggcatcaagcgcggggagacggaccaccacgcggtcagccgcggctccgccaagctccggtggttcgtggagcgcaacatggtgaccccggagggcaaggtcgtggacctggggtgcggccgcggcgggtggagctactactgcggcgggctgaagaacgtgcgcgaggtcaaggggctcaccaagggcgggcccgggcacgaggagcccatccccatgtccacctacggctggaacctggtgcggctgcagagcggggtggacgtcttcttcacgccgcccgagaagtgcgacaccctcctgtgcgacatcggcgagagctcccccaaccccaccatcgaggccggccgcaccctgcgggtgctcaacctggtggagaactggctgaacaacaacacgcagttctgcatcaaggtcctcaacccgtacatgcccagcgtgatcgagaagatggagaccctgcagcgcaagtacgggggcgccctggtgcggaaccccctgtcccgcaacagcacccacgagatgtactgggtctccaacgccaccgggaacatcgtgagctccgtgaacatgatcagccgcatgctcatcaaccggttcaccatgaagcacaagaaggcgacgtacgagccggacgtcgacctgggctccgggacccgcaacatcggcatcgagaacgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcctccagcatggtgaacggggtggtccgcctcctgaccaagccctgggacgtggtgccgatggtcacccagatggccatgacggacaccacccccttcggccagcagcgggtgttcaaggagaaggtggacacccgcacgcaggagcccaaggagggcaccaagaagctgatgcggatcaccgccgagtggctctggaaggagctggggaagaagaagacgccccggatgtgcacgcgggaggagttcacccgcaaggtccggtccaacgcggccctgggcgccatcttcaccgacgagaacaagtggaagtccgcccgcgaggccgtggaggactcccggttctgggagctcgtcgaccgcgagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttctcccgggggaacagcctgagcggcgtggagggggagggcctccacaagctgggctacatcctgcgcgacgtctccaagaaggagggcggggcgatgtacgccgacgacacggccgggtgggacacccggatcaccctcgaggacctgaagaacgaggagatggtgaccaaccacatgaagggcgagcacaagaagctggccgaggccatcttcaagctcacgtaccagaacaaggtggtccgcgtgcagcgcccgacgccccgggggaccgtgatggacatcatcagccgcaaggaccagcggggctccggccaggtcgggacctacggcctgaacacgttcaccaacatggaggcgcagctgatccgccagatggagggggagggcatcttcaagagcatccagcacctcaccgtgaccgaggagatcgccgtgcagaactggctggcccgggtcggccgcgagcggctgtcccgcatggccatcagcggggacgactgcgtggtgaagcccctcgacgaccggttcgcctccgcgctgacggccctgaacgacatgggcaaggtccgcaaggacatccagcagtgggagcccagccgggggtggaacgactggacccaggtgccgttctgctcccaccacttccacgagctcgtgatgaaggacggccgcgtcctggtggtgccctgccggaaccaggacgagctgatcgggcgcgcccggatcagccagggcgccggctggtccctcaaggagaccgcctgcctgggcaagagctacgcgcagatgtggaccctgatgtacttccaccgccgggacctccgcctggccgccaacgccatctgctccgccgtccccagccactgggtgcccacgtcccggaccacctggagcatccacgcgaagcacgagtggatgaccaccgaggacatgctggccgtgtggaaccgcgtctggatccaggagaacccgtggatggaggacaagacgcccgtggagtcctgggaggaggtgccctacctcggcaagcgcgaggaccagtggtgcgggagcctgatcggcctgaccagccgggccacctgggccaagaacatccagaccgcgatcaaccaggtccgctccctcatcgggaacgaggagtacacggactacatgcccagcatgaagcggttccgcaaggaggaggaggaggccggcgtgctgtggtga

SEQ ID NO: 9397 - RNA, 9876 nt, synthetic construct
  misc_feature 1..9876: note = derived and/or modified CDS sequence (opt1) from DENV-2__EU596485__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggactcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccgccgtgaccggcggcatcttcctcttcctgatgagcgggaagggcatcgggaagatgaccctgggcatgtgctgcatcatcacggcctccatcctcctgtggtacgcgcagatccagccgcactggatcgccgccagcatcatcctggagttcttcctcatcgtcctgctgatccccgagcccgagaagcagcggacgccccaggacaaccagctcacctacgtggtgatcgccatcctgaccgtcgtggccgcgaccatggccaacgagatggggttcctggagaagacgaagaaggacctcggcctgggcagcatcatcacccaggagtccgagagcaacatcctggacatcgacctccgcccggcctccgcctggaccctgtacgccgtggcgaccacgttcgtcacccccatgctgcggcacagcatcgagaactccagcgtgaacgtgtccctcaccgccatcgccaaccaggccaccgtcctgatggggctgggccgcgggtggcccctcagcaagatggacatcggcgtgcccctgctggcgatcgggtgctactcccaggtgaacccgatcacgctcaccgccgccctgctgctcctggtcgcccactacgccatcatcggccccggcctgcaggcgaaggccacccgcgaggcccagaagcgggccgccgcggggatcatgaagaaccccaccgtggacggcatcacggtgatcgacctcgagcccatcccgtacgaccccaagttcgagaagcagctggggcaggtcatgctgctcgtgctgtgcgtgacccaggtcctgatgatgcgcaccacctgggccctctgcgaggccctgacgctggccaccggccccatcagcaccctctgggaggggaaccccggccggttctggaacaccacgatcgccgtgtccatggcgaacatcttccgcggcagctacctggccggggccggcctcctcttctccatcatgaagaacaccaccaacacccggcgcgggacgggcaacatcggcgagaccctgggggagaagtggaagtcccggctgaacgccctcggcaagtccgagttccagatctacaagaagtccgggatccaggaggtggaccgcaccctggcgaaggagggcatcaagcgcggggagaccgaccaccacgccgtctcccgcggcagcgccaagctgcggtggttcgtggagcgcaacatggtgacgccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacctacggctggaacctcgtgcggctgcagagcggggtggacgtcttcttcaccccgcccgagaagtgcgacacgctgctctgcgacatcggcgagtccagccccaaccccaccatcgaggccggccgcaccctgcgggtgctgaacctcgtggagaactggctgaacaacaacacccagttctgcatcaaggtcctgaacccgtacatgccctccgtgatcgagaagatggagacgctccagcgcaagtacgggggcgccctggtgcggaaccccctgagccgcaactccacccacgagatgtactgggtcagcaacgcgaccgggaacatcgtgtccagcgtgaacatgatctcccgcatgctgatcaaccggttcaccatgaagcacaagaaggccacctacgagccggacgtcgacctcggcagcgggacgcgcaacatcggcatcgagaacgagatccccaacctggacatcatcggcaagcggatcgagaagatcaagcaggagcacgagacctcctggcactacgaccaggaccacccctacaagacctgggcctaccacgggagctacgagaccaagcagacgggctccgccagctccatggtgaacggggtggtccgcctgctcaccaagccctgggacgtggtgccgatggtcacccagatggccatgaccgacacgacccccttcggccagcagcgggtgttcaaggagaaggtggacacccgcacccaggagcccaaggagggcacgaagaagctgatgcggatcaccgcggagtggctgtggaaggagctcgggaagaagaagacgccccggatgtgcacccgggaggagttcgcccgcaaggtccggagcaacgccgccctgggcgccatcttcacggacgagaacaagtggaagtccgcgcgcgaggccgtggaggacagccggttctgggagctggtcgaccgcgagcggaacctccacctggaggggaagtgcgagacctgcgtgtacaacatgatgggcaagcgcgagaagaagctgggggagttcggcaaggccaagggctcccgggccatctggtacatgtggctcggggcgcgcttcctggagttcgaggccctgggcttcctcaacgaggaccactggttcagccgggggaacagcctgtccggcgtggagggggagggcctgcacaagctcggctacatcctgcgcgacgtcagcaagaaggagggcggcgccatgtacgccgacgacaccgccgggtgggacacccggatcacgctggaggacctcaagaacgaggagatggtgaccaaccacatgaagggcgagcacaagaagctggcggaggccatcttcaagctgacctaccagaacaaggtggtccgcgtgcagcgcccgacgccccgggggacggtgatggacatcatctcccgcaaggaccagcggggcagcggccaggtcgggacctacggcctcaacaccttcaccaacatggaggcccagctgatccgccagatggagggggagggcatcttcaagtccatccagcacctgacggtgaccgaggagatcgccgtgcagaactggctcgcccgggtcggccgcgagcggctgagccgcatggcgatctccggggacgactgcgtggtgaagcccctggacgaccggttcgccagcgccctcaccgccctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgcgggctggagcctgaaggagacggcctgcctcgggaagtcctacgcccagatgtggaccctgatgtacttccaccgccgggacctgcgcctcgccgccaacgcgatctgcagcgccgtcccctcccactgggtgcccaccagccggaccacgtggtccatccacgccaagcacgagtggatgaccaccgaggacatgctggccgtgtggaaccgcgtctggatccaggagaacccgtggatggaggacaagacccccgtggagagctgggaggaggtgccctacctgggcaagcgcgaggaccagtggtgcgggagcctcatcggcctgacctcccgggcgacgtgggccaagaacatccagaccgccatcaaccaggtccgcagcctgatcgggaacgaggagtacaccgactacatgccctccatgaagcggttccgcaaggaggaggaggaggccggcgtgctctggtga

SEQ ID NO: 9398 - RNA, 9876 nt, synthetic construct
  misc_feature 1..9876: note = derived and/or modified CDS sequence (opt1) from DENV-2__EU569710__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcaccttcatcctgctgaccgccgtggcgcccagcatgaccatgcgctgcatcggcatctccaaccgggacttcgtggagggcgtcagcgggggctcctgggtggacatcgtgctcgagcacgggagctgcgtcacgaccatggccaagaacaagcccaccctggacttcgagctgatcaagaccgaggccaagcagcccgccatcctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggtacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcctgtgcgtgccgaacgccgtgatcctccagaacgcctggaaggtcagctgcaccatcctggcggccgtgtccgtcagccccctgctcctgacgtccagccagcagaaggccgactggatccccctggccctcaccatcaagggcctgaaccccaccgcgatcttcctgaccacgctctcccggaccagcaagaagcgctcctggccgctgaacgaggccgtgatggccgtgggcatggtcagcatcctggcctccagcctcctgaagaacgacatccccatgaccgggcccctggtggccggcgggctcctgaccgtgtgctacgtcctgacgggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagaccctcaccatcctgatccggacgggcctgctcgtgatcagcggggtcttcccggtgtccatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctactcccagatcggcgcgggggtctacaaggagggcaccttccacaccatgtggcacgtgacccgcggggccgtgctgatgcaccgcggcaagcggatcgagcccagctgggccgacgtcaagaaggacctgatctcctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgcggtgagcctggacttctcccccggcacgagcgggtcccccatcgtggaccggaagggcaaggtcgtggggctgtacggcaacggcgtggtcacccgcagcggggcctacgtgtccgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtcgtggccgcggagatggaggaggccctgcgggggctccccatccgctaccagacccccgccatccgggccgagcacacgggccgcgagatcgtggacctgatgtgccacgccaccttcaccatgcggctgctcagccccgtccgcgtgccgaactacaacctgatcatcatggacgaggcgcacttcaccgaccccgcctccatcgccgcccggggctacatcagcacgcgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtcaccgacttcaaggggaagacggtgtggttcgtgccgtccatcaaggccggcaacgacatcgcggcctgcctgcgcaagaacggcaagaaggtcatccagctcagccggaagaccttcgactccgagtacgtgaagacccgcgccaacgactgggacttcgtggtcaccacggacatcagcgagatgggggccaacttccgggccgagcgcgtgatcgacccccggcgctgcatgaagcccgtgatcctgaccgacggcgaggagcgggtcatcctggcggggcccatgccggtgacccactccagcgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtggacgcgatcgacggggagtaccgcctccggggcgaggcccgcaagacgttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggaccaaggagggcgagcgcaagaagctgaagccgcggtggctcgacgcccgcatctacagcgaccccctggccctgaaggagttcaaggagttcgccgcgggccggaagtccctcaccctgaacctgatcaccgagatggggcgcctccccacgttcatgacccagaaggcccgggacgccctggacaacctggccgtcctccacaccgccgaggtgggcgggcgcgcgtacaaccacgccctgagcgagctgcccgagaccctcgagacgctgctgctcctgaccctgctcgccaccgtgaccggcggcatcttcctgttcctgatgtccgggaagggcatcgggaagatgacgctcggcatgtgctgcatcatcaccgccagcatcctgctgtggtacgcccagatccagccgcactggatcgcggcctccatcatcctcgagttcttcctgatcgtcctgctcatccccgagcccgagaagcagcggacgccccaggacaaccagctgacctacgtggtgatcgccatcctgaccgtcgtggccgccacgatggcgaacgagatggggttcctcgagaagaccaagaaggacctgggcctgggcagcatcatcacccaggagagcgagtccaacatcctcgacatcgacctgcgcccggccagcgcctggaccctgtacgccgtggccacgaccttcgtcacccccatgctccggcactccatcgagaacagctccgtgaacgtgagcctgaccgcgatcgccaaccaggccacggtcctgatggggctcggccgcgggtggcccctgtccaagatggacatcggcgtgcccctgctcgccatcgggtgctacagccaggtgaacccgatcaccctgaccgcggccctgctcctgctggtcgcccactacgccatcatcggccccggcctccaggccaaggcgacccgcgaggcccagaagcgggccgccgccgggatcatgaagaaccccacggtggacggcatcaccgtgatcgacctggagcccatcccgtacgaccccaagttcgagaagcagctggggcaggtcatgctcctggtgctgtgcgtgacccaggtcctcatgatgcgcaccacgtgggcgctgtgcgaggccctgaccctcgccaccggccccatctccaccctgtgggaggggaaccccggccggttctggaacacgaccatcgccgtgagcatggccaacatcttccgcggctcctacctggcgggggccggcctcctgttcagcatcatgaagaacaccaccaacacgcggcgcgggaccggcaacatcggcgagaccctgggggagaagtggaagtcccggctcaacgccctgggcaagagcgagttccagatctacaagaagtccgggatccaggaggtggaccgcaccctggccaaggagggcatcaagcgcggggagacggaccaccacgcggtcagccgcggctccgccaagctccggtggttcgtggagcgcaacatggtgaccccggagggcaaggtcgtggacctggggtgcggccgcggcgggtggagctactactgcggcgggctgaagaacgtgcgcgaggtcaaggggctcaccaagggcgggcccgggcacgaggagcccatccccatgtccacctacggctggaacctggtgcggctgcagagcggggtggacgtcttcttcacgccgcccgagaagtgcgacaccctcctgtgcgacatcggcgagagctcccccaaccccaccatcgaggccggccgcaccctgcgggtgctcaacctggtggagaactggctgaacaacaacacgcagttctgcatcaaggtcctcaacccgtacatgcccagcgtgatcgagaagatggagaccctgcagcgcaagtacgggggcgccctggtgcggaaccccctgtcccgcaacagcacccacgagatgtactgggtctccaacgccaccgggaacatcgtgagctccgtgaacatgatcagccgcatgctcatcaaccggttcaccatgaagcacaagaaggcgacgtacgagccggacgtcgacctgggctccgggacccgcaacatcggcatcgagaacgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcctccagcatggtgaacggggtggtccgcctcctgaccaagccctgggacgtggtgccgatggtcacccagatggccatgacggacaccacccccttcggccagcagcgggtgttcaaggagaaggtggacacccgcacgcaggagcccaaggagggcaccaagaagctgatgcggatcaccgccgagtggctctggaaggagctggggaagaagaagacgccccggatgtgcacgcgggaggagttcacccgcaaggtccggtccaacgcggccctgggcgccatcttcaccgacgagaacaagtggaagtccgcccgcgaggccgtggaggactcccggttctgggagctcgtcgaccgcgagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttctcccgggggaacagcctgagcggcgtggagggggagggcctccacaagctgggctacatcctgcgcgacgtctccaagaaggagggcggggcgatgtacgccgacgacacggccgggtgggacacccggatcaccctcgaggacctgaagaacgaggagatggtgaccaaccacatgaagggcgagcacaagaagctggccgaggccatcttcaagctcacgtaccagaacaaggtggtccgcgtgcagcgcccgacgccccgggggaccgtgatggacatcatcagccgcaaggaccagcggggctccggccaggtcgggacctacggcctgaacacgttcaccaacatggaggcgcagctgatccgccagatggagggggagggcatcttcaagagcatccagcacctcaccgtgaccgaggagatcgccgtgcagaactggctggcccgggtcggccgcgagcggctgtcccgcatggccatcagcggggacgactgcgtggtgaagcccctcgacgaccggttcgcctccgcgctgacggccctgaacgacatgggcaaggtccgcaaggacatccagcagtgggagcccagccgggggtggaacgactggacccaggtgccgttctgctcccaccacttccacgagctcgtgatgaaggacggccgcgtcctggtggtgccctgccggaaccaggacgagctgatcgggcgcgcccggatcagccagggcgccggctggtccctcaaggagaccgcctgcctgggcaagagctacgcgcagatgtggaccctgatgtacttccaccgccgggacctccgcctggccgccaacgccatctgctccgccgtccccagccactgggtgcccacgtcccggaccacctggagcatccacgcgaagcacgagtggatgaccaccgaggacatgctggccgtgtggaaccgcgtctggatccaggagaacccgtggatggaggacaagacgcccgtggagtcctgggaggaggtgccctacctcggcaagcgcgaggaccagtggtgcgggagcctgatcggcctgaccagccgggccacctgggccaagaacatccagaccgcgatcaaccaggtccgctccctcatcgggaacgaggagtacacggactacatgcccagcatgaagcggttccgcaaggaggaggaggaggccggcgtgctgtggtga

SEQ ID NO: 9399 - RNA, 9876 nt, synthetic construct
  misc_feature 1..9876: note = derived and/or modified CDS sequence (opt1) from DENV-2__EU596486__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggtacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcctgtgcgtgccgaacgccgtgatcctccagaacgcctggaaggtcagctgcaccatcctggcggccgtgtccgtcagccccctgctcctgacgtccagccagcagaaggccgactggatccccctggccctcaccatcaagggcctgaaccccaccgcgatcttcctgaccacgctctcccggaccagcaagaagcgctcctggccgctgaacgaggccgtgatggccgtgggcatggtcagcatcctggcctccagcctcctgaagaacgacatccccatgaccgggcccctggtggccggcgggctcctgaccgtgtgctacgtcctgacgggccggagcgcggacctcgagctggagcgcgccgccgacgtgaagtgggaggaccaggccgagatctccgggagctcccccatcctgagcatcaccatctccgaggacggcagcatgtccatcaagaacgaggaggaggagcagaccctcaccatcctgatccggacgggcctgctcgtgatcagcggggtcttcccggtgtccatccccatcaccgccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctactcccagatcggcgcgggggtctacaaggagggcaccttccacaccatgtggcacgtgacccgcggggccgtgctgatgcaccgcggcaagcggatcgagcccagctgggccgacgtcaagaaggacctgatctcctacgggggcggctggaagctcgagggggagtggaaggagggcgaggaggtccaggtgctggccctggagcccgggaagaacccccgcgccgtccagacgaagcccggcctcttcaagaccaacaccgggaccatcggcgcggtgagcctggacttctcccccggcacgagcgggtcccccatcgtggaccggaagggcaaggtcgtggggctgtacggcaacggcgtggtcacccgcagcggggcctacgtgtccgccatcgcccagaccgagaagtccatcgaggacaaccccgagatcgaggacgacatcttccggaagaagcgcctcaccatcatggacctgcaccccggcgcggggaagacgaagcggtacctgcccgccatcgtgcgcgaggccatcaagcggggcctgcgcaccctcatcctggccccgacccgcgtcgtggccgcggagatggaggaggccctgcgggggctccccatccgctaccagacccccgccatccgggccgagcacacgggccgcgagatcgtggacctgatgtgccacgccaccttcaccatgcggctgctcagccccgtccgcgtgccgaactacaacctgatcatcatggacgaggcgcacttcaccgaccccgcctccatcgccgcccggggctacatcagcacgcgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtcaccgacttcaaggggaagacggtgtggttcgtgccgtccatcaaggccggcaacgacatcgcggcctgcctgcgcaagaacggcaagaaggtcatccagctcagccggaagaccttcgactccgagtacgtgaagacccgcgccaacgactgggacttcgtggtcaccacggacatcagcgagatgggggccaacttccgggccgagcgcgtgatcgacccccggcgctgcatgaagcccgtgatcctgaccgacggcgaggagcgggtcatcctggcggggcccatgccggtgacccactccagcgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtggacgcgatcgacggggagtaccgcctccggggcgaggcccgcaagacgttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggaccaaggagggcgagcgcaagaagctgaagccgcggtggctcgacgcccgcatctacagcgaccccctggccctgaaggagttcaaggagttcgccgcgggccggaagtccctcaccctgaacctgatcaccgagatggggcgcctccccacgttcatgacccagaaggcccgggacgccctggacaacctggccgtcctccacaccgccgaggtgggcgggcgcgcgtacaaccacgccctgagcgagctgcccgagaccctcgagacgctgctgctcctgaccctgctcgccaccgtgaccggcggcatcttcctgttcctgatgtccgggaagggcatcgggaagatgacgctcggcatgtgctgcatcatcaccgccagcatcctgctgtggtacgcccagatccagccgcactggatcgcggcctccatcatcctcgagttcttcctgatcgtcctgctcatccccgagcccgagaagcagcggacgccccaggacaaccagctgacctacgtggtgatcgccatcctgaccgtcgtggccgccacgatggcgaacgagatggggttcctcgagaagaccaagaaggacctgggcctgggcagcatcatcacccaggagagcgagtccaacatcctcgacatcgacctgcgcccggccagcgcctggaccctgtacgccgtggccacgaccttcgtcacccccatgctccggcactccatcgagaacagctccgtgaacgtgagcctgaccgcgatcgccaaccaggccacggtcctgatggggctcggccgcgggtggcccctgtccaagatggacatcggcgtgcccctgctcgccatcgggtgctacagccaggtgaacccgatcaccctgaccgcggccctgctcctgctggtcgcccactacgccatcatcggccccggcctccaggccaaggcgacccgcgaggcccagaagcgggccgccgccgggatcatgaagaaccccacggtggacggcatcaccgtgatcgacctggagcccatcccgtacgaccccaagttcgagaagcagctggggcaggtcatgctcctggtgctgtgcgtgacccaggtcctcatgatgcgcaccacgtgggcgctgtgcgaggccctgaccctcgccaccggccccatctccaccctgtgggaggggaaccccggccggttctggaacacgaccatcgccgtgagcatggccaacatcttccgcggctcctacctggcgggggccggcctcctgttcagcatcatgaagaacaccaccaacacgcggcgcgggaccggcaacatcggcgagaccctgggggagaagtggaagtcccggctcaacgccctgggcaagagcgagttccagatctacaagaagtccgggatccaggaggtggaccgcaccctggccaaggagggcatcaagcgcggggagacggaccaccacgcggtcagccgcggctccgccaagctccggtggttcgtggagcgcaacatggtgaccccggagggcaaggtcgtggacctggggtgcggccgcggcgggtggagctactactgcggcgggctgaagaacgtgcgcgaggtcaaggggctcaccaagggcgggcccgggcacgaggagcccatccccatgtccacctacggctggaacctggtgcggctgcagagcggggtggacgtcttcttcacgccgcccgagaagtgcgacaccctcctgtgcgacatcggcgagagctcccccaaccccaccatcgaggccggccgcaccctgcgggtgctcaacctggtggagaactggctgaacaacaacacgcagttctgcatcaaggtcctcaacccgtacatgcccagcgtgatcgagaagatggagaccctgcagcgcaagtacgggggcgccctggtgcggaaccccctgtcccgcaacagcacccacgagatgtactgggtctccaacgccaccgggaacatcgtgagctccgtgaacatgatcagccgcatgctcatcaaccggttcaccatgaagcacaagaaggcgacgtacgagccggacgtcgacctgggctccgggacccgcaacatcggcatcgagaacgagatccccaacctggacatcatcggcaagcggatcgagaagatcaagcaggagcacgagaccagctggcactacgaccaggaccacccctacaagacctgggcctaccacgggtcctacgagacgaagcagaccggcagcgcctccagcatggtgaacggggtggtccgcctcctgaccaagccctgggacgtgatcccgatggtgacccagatggccatgacggacaccacccccttcggccagcagcgggtcttcaaggagaaggtggacacccgcacgcaggagcccaaggagggcaccaagaagctgatgcggatcaccgccgagtggctctggaaggagctggggaagaagaagacgccccggatgtgcacgcgggaggagttcacccgcaaggtgcggtccaacgcggccctgggcgccatcttcaccgacgagaacaagtggaagtccgcccgcgaggccgtcgaggactcccggttctgggagctcgtggaccgcgagcggaacctgcacctggaggggaagtgcgagacctgcgtctacaacatgatgggcaagcgcgagaagaagctcggggagttcggcaaggcgaagggcagccgggccatctggtacatgtggctgggggcccgcttcctggagttcgaggccctcggcttcctgaacgaggaccactggttctcccgggggaacagcctgagcggcgtggagggggagggcctccacaagctgggctacatcctgcgcgacgtgtccaagaaggagggcggcgcgatgtacgccgacgacacggccgggtgggacacccggatcaccctcgaggacctgaagaacgaggagatggtcaccaaccacatgaagggcgagcacaagaagctggccgaggccatcttcaagctcacgtaccagaacaaggtggtgcgcgtccagcgcccgacgccccgggggaccgtgatggacatcatcagccgcaaggaccagcggggctccggccaggtggggacctacggcctgaacacgttcaccaacatggaggcgcagctgatccgccagatggagggggagggcatcttcaagagcatccagcacctcaccgtcaccgaggagatcgccgtgcagaactggctggcccgggtgggccgcgagcggctgtcccgcatggccatcagcggggacgactgcgtcgtgaagcccctcgacgaccggttcgcctccgcgctgacggccctgaacgacatgggcaaggtgcgcaaggacatccagcagtgggagcccagccgggggtggaacgactggacccaggtcccgttctgctcccaccacttccacgagctcgtgatgaaggacggccgcgtgctggtcgtgccctgccggagccaggacgagctgatcgggcgcgcccggatctcccagggcgccggctggagcctcaaggagaccgcctgcctggggaagtcctacgcgcagatgtggaccctgatgtacttccaccgccgggacctccgcctggccgccaacgccatctgcagcgccgtgccctcccactgggtccccacgagccggaccacctggtccatccacgcgaagcacgagtggatgaccaccgaggacatgctggccgtgtggaaccgcgtgtggatccaggagaacccgtggatggaggacaagacgcccgtcgagagctgggaggaggtgccctacctcggcaagcgcgaggaccagtggtgcgggagcctgatcggcctgacctcccgggccacctgggccaagaacatccagaccgcgatcaaccaggtgcgcagcctcatcgggaacgaggagtacatcgactacatgccctccatgaagcggttccgcaaggaggaggaggaggccggcgtcctgtggtga

SEQ ID NO: 9400 - RNA, 9876 nt, synthetic construct
  misc_feature 1..9876: note = derived and/or modified CDS sequence (opt1) from DENV-2__EU687212__SS-prME
  source 1..9876: mol_type = other RNA
accgcgggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcggcatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccgcaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcatcaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcgggggcgtgttcacctccatcgggaaggccctccaccaggtcttcggcgcgatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagtccttcgccgggcccgtgagccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgcctccgggaagctcatcacggagtggtgctgccggagctgcaccctgcccccgctgcgctaccggggcgaggacgggtgctggtacggcatggagatccgccccctcaaggagaaggaggagaacctggtcaactccctggtgaccgccgggcacggccagatcgacaacttcagcctcggcgtgctggggatggccctgttcctcgaggagatgctgcggacccgcgtcggcacgaagcacgcgatcctgctcgtggccgtgtccttcgtcaccctgatcaccgggaacatgagcttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcacctccaaggagctgatgatggccacgatcggcatcgccctgctcagccagtccaccatgcccgagaccatcctggagctgaccgacgcgctcgccctggggatgatggtcctgaagatcgtgcgcaacatggagaagtaccagctcgccgtgacgatcatggccatcagctgcgtcccgaacgccgtgatcctgcagaacgcgtggaaggtgtcctgcaccatcctggccaccgtcagcgtgagccccctcctgctgaccagctcccagcagaaggccgactggatccccctcgccctgacgatcaagggcctgaaccccaccgcgatcttcctcaccaccctgagccggacgtccaagaagcgcagctggccgctgaacgaggccatcatggccgtcggcatggtgtccatcctcgccagcagcctgctgaagaacgacatccccatgaccgggcccctcgtggccggcgggctgctgaccgtctgctacgtgctcaccggccggtccgcggacctggagctggagcgcgccgccgacgtgaagtgggaggaccaggccgagatcagcgggtccagccccatcctctccatcacgatcagcgaggacggctccatgagcatcaagaacgaggaggaggagcagaccctgaccatcctgatccggaccggcctcctggtcatctccggggtgttcccggtgagcatccccatcaccgccgcggcctggtacctgtgggaggtcaagaagcagcgcgccggcgtgctctgggacgtgcccagcccgccgcccgtcgagaaggccgagctggaggacggggcctaccggatcaagcagcgcggcatcctggggtacagccagatcggcgcgggcgtgtacaaggaggggacgttccacaccatgtggcacgtgacccggggcgccgtcctcatgcaccgcgggaagcggatcgagccctcctgggccgacgtgaagaaggacctgatcagctacggcgggggctggaagctggagggcgagtggaaggagggggaggaggtgcaggtcctcgccctggagcccggcaagaacccccgcgccgtgcagaccaagcccgggatcttcaagacgaacaccggcaccatcggggcggtgtccctggacttcagccccggcacctccggcagccccatcgtcgaccggaaggggaaggtggtgggcctctacgggaacggcgtcgtgacgcgctccggcgcctacgtgagcgccatcgcccagaccgagaagtccatcgaggacaaccccgagatcgaggacgacatcttccggaagaagcgcctgaccatcatggacctgcaccccggggcgggcaagaccaagcggtacctccccgccatcgtccgcgaggccatcaagcgggggctgcgcacgctgatcctggccccgacccgcgtggtggccgcggagatggaggaggccctccggggcctgcccatccgctaccagacccccgccatccgggccgagcacaccgggcgcgagatcgtcgacctgatgtgccacgccacgttcaccatgcggctcctgtcccccgtgcgcgtgccgaactacaacctgatcatcatggacgaggcgcacttcaccgaccccgccagcatcgccgcccggggctacatctccacccgcgtcgagatgggcgaggccgcggggatcttcatgacggccacgccgcccggcagccgggacccgttcccccagtccaacgcccccatcatggacgaggagcgcgagatccccgagcggagctggaactccgggcacgagtgggtgaccgacttcaagggcaagaccgtgtggttcgtcccgagcatcaaggccgggaacgacatcgcggcctgcctccgcaagaacggcaagaaggtgatccagctgtcccggaagacgttcgacagcgagtacgtgaagacccgcgccaacgactgggacttcgtcgtgaccaccgacatctccgagatgggcgccaacttcaaggccgagcgggtgatcgacccccgccggtgcatgaagcccgtcatcctgacggacggggaggagcgcgtgatcctcgcgggccccatgccggtgacccacagctccgccgcccagcggcgcgggcgcatcggccggaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgcgagaaggtcgacgcgatcgacggcgagtaccggctgcgcggggaggcccggaagaccttcgtggacctgatgcgccggggcgacctccccgtgtggctggcctacaaggtcgccgccgaggggatcaactacgcggaccgcaagtggtgcttcgacggcatcaagaacaaccagatcctggaggagaacgtggaggtggagatctggacgaaggagggggagcggaagaagctcaagccgcgctggctggacgcccggatctactccgaccccctggccctcaaggagttcaaggagttcgccgcgggccgcaagagcctgaccctgaacctcatcaccgagatgggccggctgcccaccttcatgacgcagaaggcccgcaacgccctggacaacctcgccgtcctgcacaccgccgaggccgggggccgggcctacaaccacgccctgtccgagctccccgagaccctggagaccctgctcctgctgacgctcctggccaccgtgaccgggggcatcttcctgttcctcatgagcggcaaggggatcggcaagatgaccctggggatgtgctgcatcatcaccgcctccatcctgctctggtacgcgcagatccagccgcactggatcgccgccagcatcatcctggagttcttcctgatcgtcctcctgatccccgagcccgagaagcagcgcacgccccaggacaaccagctgacctacgtggtgatcgccatcctcaccgtcgtggccgcgaccatggccaacgagatgggcttcctggagaagacgaagaaggacctggggctcggcagcatcaccacccaggagtccgagagcaacatcctggacatcgacctgcggccggcctccgcctggaccctctacgccgtggcgacgaccttcgtcacccccatgctgcgccacagcatcgagaactccagcgtgaacgtgtccctgaccgccatcgccaaccaggccacggtcctcatgggcctggggaagggctggcccctgagcaagatggacatcggggtgcccctcctggcgatcggctgctactcccaggtgaacccgatcaccctgaccgccgccctcctgctgctcgtcgcccactacgccatcatcgggcccggcctgcaggcgaaggccacccgggaggcccagaagcgcgccgccgcgggcatcatgaagaaccccacggtggacgggatcaccgtgatcgacctggagcccatcccgtacgaccccaagttcgagaagcagctcggccaggtcatgctgctgatcctctgcgtgacccaggtgctgatgatgcggaccacgtgggccctgtgcgaggccctcaccctggccaccgggcccatcagcaccctgtgggagggcaaccccgggcgcttctggaacacgaccatcgccgtctccatggcgaacatcttccgcggcagctacctcgccggcgccgggctgctgttctccatcatgaagaacaccaccaacacgcggcgcggcaccgggaacatcggcgagaccctcggcgagaagtggaagtcccggctgaacgccctggggaagtccgagttccagatctacaagaagtccggcatccaggaggtggaccgcaccctcgcgaaggaggggatcaagcggggcgagacggaccaccacgccgtgtcccgcgggagcgccaagctgcggtggttcgtcgagcgcaacatggtgaccccggagggcaaggtggtcgacctgggctgcgggcggggcgggtggtcctactactgcggcgggctcaagaacgtgcgcgaggtgaagggcctgaccaagggcgggcccggccacgaggagcccgtccccatgagcacctacgggtggaacctggtgcggctccagagcggcgtggacgtcttcttcacgccgcccgagaagtgcgacaccctgctgtgcgacatcggggagtccagccccaaccccaccatcgaggccggccgcaccctccgggtgctgaacctggtggagaactggctcaacaacaacacccagttctgcatcaaggtcctgaacccgtacatgccctccgtgatcgagaagatggagacgctgcagcgcaagtacggcggggccctcgtgcggaaccccctgagccgcaactccacccacgagatgtactgggtcagcaacgcgaccggcaacatcgtgtccagcgtgaacatgatctcccggatgctgatcaaccgcttcaccatgaagcacaagaaggccacgtacgagccggacgtcgacctggggagcggcacccggaacatcgggatcgagtccgagatccccaacctcgacatcatcggcaagcgcatcgagaagatcaagcaggagcacgagaccagctggcactacgaccaggaccacccctacaagacctgggcctaccacggctcctacgagacgaagcagaccgggagcgcctccagcatggtgaacggcgtggtccgcctgctgaccaagccctgggacgtggtgccgatggtcacccagatggccatgacggacaccacccccttcgggcagcagcgggtgttcaaggagaaggtggacacccgcacgcaggagcccaaggagggcaccaagaagctcatgaagatcaccgcggagtggctgtggaaggagctgggcaagaagaagacgccccggatgtgcacgcgcgaggagttcaccaagaaggtccggtccaacgccgccctcggggccatcttcaccgacgagaacaagtggaagtccgcccgcgaggcggtggaggacggccggttctgggagctggtggaccgcgagcggaacctgcacctcgaggggaagtgcgagacctgcgtctacaacatgatgggcaagcgcgagaagaagctgggggagttcggcaaggccaagggctcccgggccatctggtacatgtggctgggggcccgcttcctcgagttcgaggcgctgggcttcctgaacgaggaccactggttcagccgggggaacagcctctccggcgtggagggggagggcctgcaccgcctgggctacatcctccgggaggtcgggaagaaggagggcggggccatgtacgccgacgacacggccggctgggacacccgcatcaccctggaggacctgaagaacgaggagatggtgaccaaccacatgaagggggagcacaagaagctcgccgaggcgatcttcaagctgacgtaccagaacaaggtggtccgggtgcagcgcccgacgccccggggcaccgtgatggacatcatcagccgccgggaccagcgcggctccgggcaggtcggcacctacgggctgaacacgttcaccaacatggaggcccagctcatccgccagatggagggcgagggcatcttcaagagcatccagcacctgaccgccaccgaggagatcgccgtgcagaactggctggcccgggtggggcgcgagcggctctcccgcatggcgatcagcggcgacgactgcgtcgtgaagcccatcgacgaccggttcgcctccgccctgacggccctgaacgacatggggaaggtgcgcaaggacatccagcagtgggagcccagccggggctggaacgactggacccaggtcccgttctgctcccaccacttccacgagctcgtgatgaaggacgggcgcgtgctggtcgtgccctgccggaaccaggacgagctgatcggccgcgcccggatcagccagggcgcggggtggtccctcaaggagaccgcctgcctgggcaagagctacgcccagatgtggaccctgatgtacttccaccgccgggacctccgcctggccgccaacgcgatctgctccgccgtgcccagccactgggtccccacctcccggacgacctggagcatccacgccaagcacgagtggatgaccaccgaggacatgctggccgtgtggaaccgcgtgtggatccaggagaacccgtggatggaggacaagacgcccgtcgagtcctgggaggaggtgccctacctcgggaagcgggaggaccagtggtgcggcagcctgatcgggctgaccagccgcgcgacctgggccaagaacatccagaccgccatcaaccaggtgcggtccctcatcggcaacgaggagtacacggactacatgcccagcatgaagcgcttccgccgggaggaggaggaggccggcgtcctgtggtga

SEQ ID NO: 9401 - RNA, 9876 nt, synthetic construct
  misc_feature 1..9876: note = derived and/or modified CDS sequence (opt1) from DENV-2__EU660400__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacccacttccagcgggccctcatcttcatcctgctgaccaccgtggcccccagcatgaccatgcgctgcatcggcatctccaaccgggacttcgtggagggcgtcagcgggggctcctgggtggacatcgtgctcgagcacgggagctgcgtcaccaccatggcgaagaacaagcccaccctggacttcgagctgatcaagaccgaggccaagcagcccgccacgctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcggcctgttcggcaagggcgggatcgtgacctgcgccatgttcacgtgcaagaagaacatggagggcaaggtcgtgctgcccgagaacctggagtacacgatcgtgatcacgccccacagcggggaggagcacgcggtcggcaacgacaccgggaagcacggcaaggagatcaagatcaccccgcagtccagcatcaccgaggccgagctcacggggtacggcaccgtgaccatggagtgcagcccccggaccggcctggacttcaacgagatggtgctgctccagatggaggacaaggcctggctggtccaccggcagtggttcctggacctccccctgccctggctgccgggggccgacacgcagggcagcaactggatccagaaggagaccctcgtgaccttcaagaacccccacgccaagaagcaggacgtggtcgtgctggggtcccaggagggcgcgatgcacaccgccctgacgggggccaccgagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggccgagccgcccttcggcgactcctacatcatcatcggggtggagccgggccagctcaagctgaactggttcaagaaggggagctccatcggccagatgttcgagacgaccatgcgcggcgcgaagcggatggccatcctgggggacaccgcctgggacttcggcagcctcgggggcgtgttcacctccatcgggaaggccctgcaccaggtcttcggcgccatctacggcgcggccttcagcggggtgtcctggacgatgaagatcctgatcggcgtgatcatcacctggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcacggacaacgtccacacctggaccgagcagtacaagttccagcccgagagccccagcaagctggcctccgcgatccagaaggcccacgaggagggcatctgcgggatccggagcgtgacccgcctcgagaacctgatgtggaagcagatcacgcccgagctgaaccacatcctctccgagaacgaggtgaagctgaccatcatgaccggcgacatcaaggggatcatgcaggccggcaagcggagcctgcgcccgcagcccaccgagctcaagtactcctggaagacgtggggcaaggccaagatgctgagcaccgagtcccacaaccagaccttcctgatcgacgggcccgagaccgccgagtgcccgaacacgaaccgggcgtggaacagcctcgaggtcgaggactacggcttcggggtgttctccaccaacatctggctgaagctgcgcgagaagcaggacgtgttctgcgacagcaagctcatgtccgccgccatcaaggacaaccgggccgtccacgccgacatgggctactggatcgagagcgcgctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagacggccgggccctggcacctgggcaagctggagatggacttcgacttctgcgaggggaccaccgtggtggtcaccgaggactgcggcaaccggggccccagcctccgcacgaccaccgcctccgggaagctgatcaccgagtggtgctgccggagctgcacgctgcccccgctccgctaccggggcgaggacgggtgctggtacggcatggagatccgccccctgaaggagaaggaggagaacctggtgaactccctcgtgaccgcggggcacggccagatcgacaacttcagcctgggcgtcctggggatggccctcttcctggaggagatgctgcggacccgcgtgggcaccaagcacgccatcctcctggtggccgtctccttcgtgacgctgatcaccgggaacatgagcttccgggacctcggccgcgtgatggtcatggtgggggcgaccatgaccgacgacatcggcatgggcgtgacgtacctggccctgctcgccgccttcaaggtccgccccaccttcgccgcggggctgctgctccggaagctgacctccaaggagctgatgatggccaccatcggcatcgccctcctgagccagtccacgatccccgagaccatcctggagctcaccgacgccctggccctggggatgatggtgctcaagatcgtgcgcaacatggagaagtaccagctggcggtcaccatcatggccatcagctgcgtgccgaacgccgtgatcctgcagaacgcctggaaggtctcctgcacgatcctcgccgcggtgagcgtcagccccctgctgctcaccagctcccggcagaaggccgactggatccccctggccctgaccatcaagggcctcaaccccaccgccatcttcctgacgaccctgagccgcacctccaagaagcggagctggccgctcaacgaggcggtgatggccgtgggcatggtctccatcctggccagcagcctgctcaagaacgacatccccatgaccgggcccctggtggccggcgggctgctcacggtgtgctacgtcctgaccggccgctccgccgacctggagctcgagcgggcggccgacgtgaagtgggaggaccaggccgagatcagcgggtccagccccatcctgtccatcaccatcagcgaggacggctccatgagcatcaagaacgaggaggaggagcacaccctgacgatcctcatccgcaccggcctgctggtgatctccggggtcttcccggtgagcatccccatcaccgccgccgcgtggtacctctgggaggtgaagaagcagcgggccggcgtcctgtgggacgtgcccagcccgccgcccgtggggaaggccgagctggaggacggcgcctaccgcatcaagcagcgggggatcttcggctacagccagatcggcgccggggtctacaaggagggcaccttccacaccatgtggcacgtgacgcgcggggcggtgctcatgcaccggggcaagcgcatcgagccctcctgggccgacgtcaagaaggacctgatcagctacgggggcggctggaagctggagggggagtggaaggagggcgaggaggtccaggtgctcgccctggagcccgggaagaacccccgggccgtccagaccaagcccggcctgttcaagaccaacaccgggacgatcggcgccgtgtccctcgacttcagccccggcacctccgggagccccatcgtggaccgcaagggcaaggtcgtggggctgtacggcaacggcgtggtcacccggtccggggcgtacgtgagcgccatcgcccagaccgagaagtccatcgaggacaaccccgagatcgaggacgacatcttccgcaagaagcggctgacgatcatggacctccaccccggcgccgggaagaccaagcgctacctgcccgcgatcgtgcgggaggccatcaagcgcggcctgcgcaccctgatcctcgccccgacccgggtcgtggccgccgagatggaggaggcgctgcgcgggctgcccatccggtaccagacgcccgccatccgcgccgagcacaccggccgggagatcgtggacctcatgtgccacgccaccttcaccatgcgcctgctgtcccccgtccgggtgccgaactacaacctcatcatcatggacgaggcccacttcacggaccccgcgagcatcgccgcccgcggctacatctccacccgggtggagatgggggaggccgccggcatcttcatgaccgcgacgccgcccgggagccgcgacccgttcccccagtccaacgcccccatcatggacgaggagcgggagatccccgagcgcagctggaactccggccacgagtgggtcacggacttcaaggggaagaccgtgtggttcgtgccgagcatcaaggccggcaacgacatcgccgcgtgcctgcggaagaacggcaagaaggtcatccagctgtcccgcaagaccttcgacagcgagtacgtgaagacccgggccaacgactgggacttcgtggtcacgaccgacatctccgagatgggggccaacttccgcgccgagcgggtgatcgacccccgccggtgcatgaagcccgtgatcctcaccgacggcgaggagcgcgtcatcctggccgggcccatgccggtgacccacagctccgcggcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgcgagaaggtggacgccatcgacggggagtaccggctgcgcggcgaggcgcggaagaccttcgtcgacctcatgcgccgcggggacctgcccgtgtggctggcctaccgcgtggccgccgagggcatcaactacgccgaccggcgctggtgcttcgacgggatcaagaacaaccagatcctcgaggagaacgtcgaggtggagatctggaccaaggagggcgagcggaagaagctgaagccgcgctggctggacgcgcggatctactccgaccccctcgccctgaaggagttcaaggagttcgccgccggccgcaagagcctgaccctcaacctgatcacggagatggggcggctgcccaccttcatgacccagaaggcgcgcgacgccctcgacaacctggccgtcctgcacaccgccgaggtgggcgggcgggcctacaaccacgcgctctccgagctgcccgagacgctggagaccctcctgctgctcaccctgctggccaccgtgacgggcggcatcttcctcttcctgatgagcgggaagggcatcgggaagatgaccctgggcatgtgctgcatcatcaccgcctccatcctcctgtggtacgcccagatccagccgcactggatcgccgcgagcatcatcctggagttcttcctcatcgtcctgctgatccccgagcccgagaagcagcgcacgccccaggacaaccagctcacctacgtggtgatcgccatcctgacggtcgtggccgccaccatggccaacgagatggggttcctggagaagaccaagaaggacctcggcctgggcagcatcaccacgcaggagtccgagagcaacatcctggacatcgacctccggccggcgtccgcctggaccctgtacgccgtggccaccaccttcgtcacgcccatgctgcgccacagcatcgagaactccagcgtgaacgtgtccctcaccgccatcgcgaaccaggccaccgtcctgatggggctgggccgcgggtggcccctcagcaagatggacatcggcgtgcccctgctggccatcgggtgctactcccaggtgaacccgatcaccctcacggccgcgctgctgctcctggtcgcccactacgccatcatcggccccggcctgcaggccaaggccacccgggaggcgcagaagcgcgccgccgccgggatcatgaagaaccccaccgtggacggcatcaccgtgatcgacctcgagcccatcccgtacgaccccaagttcgagaagcagctggggcaggtcatgctgctcgtgctgtgcgtgacgcaggtcctgatgatgcggaccacctgggccctctgcgaggcgctgaccctggccacgggccccatcagcaccctctgggaggggaaccccggccgcttctggaacaccaccatcgccgtgtccatggccaacatcttccggggcagctacctggccggggcgggcctcctcttctccatcatgaagaacacgaccaacacccgccgggggaccggcaacatcggcgagacgctgggggagaagtggaagtcccgcctgaacgccctcggcaagtccgagttccagatctacaagaagtccgggatccaggaggtggaccggaccctggccaaggagggcatcaagcgcggggagaccgaccaccacgccgtctcccggggcagcgcgaagctgcgctggttcgtggagcggaacatggtgaccccggagggcaaggtcgtggacctcgggtgcggccgcgggggctggtcctactactgcgggggcctgaagaacgtgcgggaggtcaagggcctgacgaagggcgggcccgggcacgaggagcccatccccatgagcacctacggctggaacctcgtgcgcctgcagagcggggtggacgtcttcttcaccccgcccgagaagtgcgacaccctgctctgcgacatcggcgagtccagccccaaccccacgatcgaggccggccggaccctgcgcgtgctgaacctcgtggagaactggctgaacaacaacacccagttctgcatcaaggtcctgaacccgtacatgccctccgtgatcgagaagatggagaccctccagcggaagtacgggggcgccctggtgcgcaaccccctgagccgcaactccacccacgagatgtactgggtcagcaacgccacggggaacatcgtgtccagcgtgaacatgatctcccggatgctgatcaaccgcttcaccatgaagcacaagaaggccacctacgagccggacgtcgacctcggcagcgggacccggaacatcggcatcgagaacgagatccccaacctggacatcatcggcaagcgcatcgagaagatcaagcaggagcacgagacgtcctggcactacgaccaggaccacccctacaagacctgggcgtaccacgggagctacgagaccaagcagaccggctccgccagctccatggtgaacggggtggtcaagctgctcacgaagccctgggacgtggtgccgatggtcacccagatggccatgaccgacaccacgcccttcggccagcagcgggtgttcaaggagaaggtggacacccgcacccaggagcccaaggagggcaccaagaagctgatgcggatcacggccgagtggctgtggaaggagctcgggaagaagaagacgccccgcatgtgcacccgggaggagttcacccgcaaggtccggagcaacgccgcgctgggcgccatcttcacggacgagaacaagtggaagtccgcccgcgaggccgtggaggacagccggttctgggagctggtcgaccgcgagcggaacctccacctggaggggaagtgcgagacctgcgtgtacaacatgatgggcaagcgcgagaagaagctgggggagttcggcaaggccaagggctcccgggcgatctggtacatgtggctcggggcccgcttcctggagttcgaggccctgggcttcctcaacgaggaccactggttcagccgggggaacagcctgtccggcgtggagggggagggcctgcacaagctcggctacatcctgcgcgacgtcagcaagaaggagggcggggccatgtacgcggacgacaccgccgggtgggacacccggatcacgctggaggacctcaagaacgaggagatggtgaccaaccacatgaagggcgagcacaagaagctggccgaggccatcttcaagctgacctaccagaacaaggtggtccgcgtgcagcgcccgacgccccgggggacggtgatggacatcatctcccgcaaggaccagcggggcagcggccaggtcgggacctacggcctcaacaccttcaccaacatggaggcccagctgatccgccagatggagggggagggcatcttcaagtccatccagcggctgacggtgaccgaggagatcgcggtgcagaactggctcgcccgcgtcggccgggagcgcctgagccggatggccatctccggggacgactgcgtggtgaagcccctggacgaccgcttcgccagcgccctcaccgcgctgaacgacatgggcaaggtccggaaggacatccagcagtgggagccctcccgcgggtggaacgactggacccaggtgccgttctgcagccaccacttccacgagctggtgatgaaggacggccgggtcctcgtggtgccctgccgcaaccaggacgagctgatcgggcgggcccgcatctcccagggcgccggctggagcctgaaggagacggcctgcctcgggaagtcctacgcccagatgtggaccctgatgtacttccaccggcgcgacctgcggctcgcggccaacgccatctgcagcgccgtcccctcccactgggtgcccaccagccgcaccacctggtccatccacgccaagcacgagtggatgacgaccgaggacatgctggcggtgtggaaccgcgtctggatccaggagaacccgtggatggaggacaagacccccgtggagagctgggaggaggtgccctacctgggcaagcgggaggaccagtggtgcgggagcctcatcggcctgacctcccgcgccacgtgggccaagaacatccagaccgccatcaaccaggtccggagcctgatcgggaacgaggagtacaccgactacatgccctccatgaagcgcttccggaaggaggaggaggaggcgggcgtgctctggtga

SEQ ID NO: 9402 - RNA, 9876 nt, synthetic construct
  misc_feature 1..9876: note = derived and/or modified CDS sequence (opt1) from DENV-2__EU569711__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacatcctggggcgcctgatcaccgtcaacccgatcgtgaccgagaaggacagccccgtgaacatcgaggcggagccgcccttcggcgactcctacatcatcatcggggtcgagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtgttcggcgcgatctacggcgccgccttcagcggggtctcctggaccatgaagatcctgatcggcgtgatcatcacgtggatcgggatgaacagccgctccaccagcctgtccgtgagcctcgtcctggtgggcgtggtcaccctgtacctcggggtgatggtgcaggccgactccggctgcgtcgtgagctggaagaacaaggagctgaagtgcggctccgggatcttcatcaccgacaacgtgcacacgtggaccgagcagtacaagttccagcccgagagccccagcaagctggcgtccgccatccagaaggcccacgaggagggcatctgcgggatccggagcgtcacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtggaggactacggcttcggggtcttctccacgaacatctggctgaagctgcgcgagaagcaggacgtgttctgcgacagcaagctcatgtccgccgccatcaaggacaaccgggccgtgcacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgacggccgggcacggccagatcgacaacttcagcctgggcgtgctggggatggccctcttcctggaggagatgctgcggacccgcgtcggcaccaagcacgccatcctcctggtggcggtgtccttcgtcaccctgatcacggggaacatgagcttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtcatggccgtgggcatggtgtccatcctggccagcagcctgctcaagaacgacatccccatgaccgggcccctggtcgccggcgggctgctcaccgtgtgctacgtgctgacgggccggtccgcggacctggagctcgagcgcgccgccgacgtcaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtgttcccggtcagcatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacaccatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgcggtctccctcgacttcagccccggcacgtccgggagccccatcgtggaccggaagggcaaggtggtcgggctgtacggcaacggcgtggtgacccgctccggggcctacgtcagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtggtcgccgcggagatggaggaggccctgcgggggctgcccatccgctaccagacccccgccatccgggccgagcacacgggccgcgagatcgtggacctcatgtgccacgccaccttcaccatgcggctgctgtcccccgtgcgcgtcccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggccggcaacgacatcgcggcctgcctgcgcaagaacggcaagaaggtgatccagctgtcccggaagaccttcgacagcgagtacgtcaagacccgcgccaacgactgggacttcgtggtgaccacggacatctccgagatgggggccaacttccgggccgagcgcgtcatcgacccccggcgctgcatgaagcccgtgatcctcaccgacggcgaggagcgggtgatcctggcggggcccatgccggtcacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggtcggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtgacccccatgctgcggcacagcatcgagaactccagcgtcaacgtgtccctcacggcgatcgccaaccaggccaccgtgctgatggggctgggccgcgggtggcccctcagcaagatggacatcggcgtccccctgctggccatcgggtgctactcccaggtgaacccgatcaccctcaccgcggccctgctgctcctggtggcccactacgccatcatcggccccggcctgcaggccaaggcgacgcgcgaggcccagaagcgggccgccgccgggatcatgaagaaccccaccgtcgacggcatcaccgtgatcgacctcgagcccatcccgtacgaccccaagttcgagaagcagctgggccaggtgatgctgctcgtcctgtgcgtgacccaggtgctgatgatgcgcacgacctgggcgctctgcgaggccctgaccctggccaccggccccatcagcacgctctgggaggggaaccccggccggttctggaacaccaccatcgccgtctccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtgtcccgcggcagcgccaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgaccaagggcgggcccgggcacgaggagcccatccccatgagcacgtacggctggaacctcgtccggctgcagagcggggtggacgtgttcttcaccccgcccgagaagtgcgacaccctgctctgcgacatcggcgagtccagccccaaccccaccatcgaggccggccgcacgctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccaccgggaacatcgtctccagcgtgaacatgatctcccgcatgctgatcaaccggttcacgatgaagcacaagaaggcgacctacgagccggacgtggacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtcaacggggtggtgcgcctgctcaccaagccctgggacgtcgtgccgatggtgacgcagatggccatgaccgacaccacccccttcggccagcagcgggtcttcaaggagaaggtggacacgcgcacccaggagcccaaggagggcaccaagaagctgatgcggatcaccgccgagtggctgtggaaggagctcgggaagaagaagacgccccgcatgtgcacccgggaggagttcacccgcaaggtgcggagcaacgcggccctgggcgccatcttcaccgacgagaacaagtggaagtccgcccgcgaggccgtcgaggacagccggttctgggagctggtggaccgcgagcggaacctccacctggaggggaagtgcgagacgtgcgtctacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaacagcctgtccggcgtggagggggagggcctgcacaagctcggctacatcctgcgcgacgtgagcaagaaggagggcggggcgatgtacgccgacgacaccgccgggtgggacacccggatcaccctggaggacctcaagaacgaggagatggtcacgaaccacatgaagggcgagcacaagaagctggccgaggccatcttcaagctgacctaccagaacaaggtggtgcgcgtccagcgcccgacgccccgggggaccgtgatggacatcatctcccgcaaggaccagcggggcagcggccaggtggggacgtacggcctcaacaccttcaccaacatggaggcgcagctgatccgccagatggagggggagggcatcttcaagtccatccagcggctgaccgtcacggaggagatcgccgtgcagaactggctcgcccgcgtgggccgggagcgcctgagccggatggccatctccggggacgactgcgtcgtgaagcccctggacgaccgcttcgccagcgcgctcaccgccctgaacgacatgggcaaggtgcggaaggacatccagcagtgggagccctcccgcgggtggaacgactggacccaggtcccgttctgcagccaccacttccacgagctggtgatgaaggacggccgggtgctcgtcgtgccctgccgcaaccaggacgagctgatcgggcgggcccgcatctcccagggcgccggctggagcctgaaggagaccgcctgcctcgggaagtcctacgcgcagatgtggacgctgatgtacttccaccggcgcgacctgcggctcgccgccaacgccatctgcagcgccgtgccctcccactgggtccccaccagccgcaccacctggtccatccacgcgaagcacgagtggatgaccacggaggacatgctggccgtgtggaaccgcgtgtggatccaggagaacccgtggatggaggacaagacccccgtcgagagctgggaggaggtgccctacctgggcaagcgggaggaccagtggtgcgggagcctcatcggcctgacctcccgcgccacctgggccaagaacatccagacggcgatcaaccaggtgcggagcctgatcgggaacgaggagtacaccgactacatgccctccatgaagcgcttccggaaggaggaggaggaggccggcgtcctctggtga

SEQ ID NO: 9403 - RNA, 9876 nt, synthetic construct
  misc_feature 1..9876: note = derived and/or modified CDS sequence (opt1) from DENV-2__EU569712__SS-prME
  source 1..9876: mol_type = other RNA
accgccgggatgatcatcatgctgatccccaccgccatggcgttccacctcaccacccgcaacggggagccccacatgatcgtggggcggcaggagaaggggaagtccctgctgttcaagaccgaggacggcgtcaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtggccctggtcccccacgtggggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtcgcgcccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcggcctcttcggcaagggcgggatcgtgacctgcgcgatgttcacgtgcaagaagaacatggagggcaaggtggtcctgcccgagaacctggagtacaccatcgtgatcacgccccacagcggggaggagcacgccgtgggcaacgacaccgggaagcacggcaaggagatcaagatcaccccgcagtccagcatcaccgaggccgagctcaccgggtacggcacggtcaccatggagtgcagcccccggaccggcctggacttcaacgagatggtgctgctccagatggaggacaaggcctggctggtgcaccggcagtggttcctggacctccccctgccctggctgccgggggccgacacccagggcagcaactggatccagaaggagacgctcgtcaccttcaagaacccccacgcgaagaagcaggacgtggtggtcctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctcgagaagcggtacgtgctggggcgcctgatcaccgtcaacccgatcgtgaccgagaaggacagccccgtgaacatcgaggcggagccgcccttcggcgactcctacatcatcatcggggtcgagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtgttcggcgcgatctacggcgccgccttcagcggggtctcctggaccatgaagatcctgatcggcgtgatcatcacgtggatcgggatgaacagccgctccaccagcctgtccgtgagcctcgtcctggtgggcgtggtcaccctgtacctcggggtgatggtgcaggccgactccggctgcgtcgtgagctggaagaacaaggagctgaagtgcggctccgggatcttcatcaccgacaacgtgcacacgtggaccgagcagtacaagttccagcccgagagccccagcaagctggcgtccgccatccagaaggcccacgaggagggcatctgcgggatccggagcgtcacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtggaggactacggcttcggggtcttctccacgaacatctggctgaagctgcgcgagaagcaggacgtgttctgcgacagcaagctcatgtccgccgccatcaaggacaaccgggccgtgcacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgacggccgggcacggccagatcgacaacttcagcctgggcgtgctggggatggccctcttcctggaggagatgctgcggacccgcgtcggcaccaagcacgccatcctcctggtggcggtgtccttcgtcaccctgatcacggggaacatgagcttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtcctcaagatcgtgcgcaacatggagaagtaccagctggccgtgaccatcatggccatcctgtgcgtcccgaacgccgtgatcctccagaacgcctggaaggtgagctgcaccatcctggcggccgtctccgtgagccccctgctcctgacgtccagccagcagaaggccgactggatccccctggccctcaccatcaagggcctgaaccccaccgcgatcttcctgaccacgctctcccggaccagcaagaagcgctcctggccgctgaacgaggccgtcatggccgtgggcatggtgagcatcctggcctccagcctcctgaagaacgacatccccatgaccgggcccctggtcgccggcgggctcctgaccgtgtgctacgtgctgacgggccggagcgcggacctcgagctggagcgcgccgccgacgtcaagtgggaggaccaggccgagatctccgggagctcccccatcctgagcatcaccatctccgaggacggcagcatgtccatcaagaacgaggaggaggagcagaccctcaccatcctgatccggacgggcctgctcgtgatcagcggggtgttcccggtctccatccccatcaccgccgcggcctggtacctgtgggaggtgaagaagcagcgcgccggcgtgctgtgggacgtccccagcccgccgcccgtggagaaggccgagctcgaggacggggcctaccggatcaagcagcgcggcatcttcgggtactcccagatcggcgcgggcgtgtacaaggaggggaccttccacaccatgtggcacgtcacccggggcgccgtgctgatgcaccgcgggaagcggatcgagcccagctgggccgacgtgaagaaggacctgatctcctacggcgggggctggaagctcgagggcgagtggaaggagggggaggaggtccaggtgctggccctggagcccggcaagaacccccgcgccgtgcagacgaagcccggcctcttcaagaccaacaccggcaccatcggggcggtcagcctggacttctcccccggcacgagcggctcccccatcgtggaccggaaggggaaggtggtcggcctgtacgggaacggcgtggtgacccgcagcggcgcctacgtctccgccatcgcccagaccgagaagtccatcgaggacaaccccgagatcgaggacgacatcttccggaagaagcgcctcaccatcatggacctgcaccccggggcgggcaagacgaagcggtacctgcccgccatcgtgcgcgaggccatcaagcgggggctgcgcaccctcatcctggccccgacccgcgtggtcgccgcggagatggaggaggccctgcggggcctccccatccgctaccagacccccgccatccgggccgagcacacggggcgcgagatcgtggacctgatgtgccacgccaccttcaccatgcggctgctcagccccgtgcgcgtcccgaactacaacctgatcatcatggacgaggcgcacttcaccgaccccgcctccatcgccgcccggggctacatcagcacgcgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtgaccgacttcaagggcaagacggtctggttcgtgccgtccatcaaggccgggaacgacatcgcggcctgcctgcgcaagaacggcaagaaggtgatccagctcagccggaagaccttcgactccgagtacgtcaagacccgcgccaacgactgggacttcgtggtgaccacggacatcagcgagatgggcgccaacttccgggccgagcgcgtcatcgacccccggcgctgcatgaagcccgtgatcctgaccgacggggaggagcgggtgatcctggcgggccccatgccggtcacccactccagcgccgcccagcgccgcgggcggatcggccgcaaccccaagaacgagaacgaccagtacatctacatgggggagcccctcgagaacgacgaggactgcgcccactggaaggaggccaagatgctgctggacaacatcaacacccccgagggcatcatcccgtccatgttcgagcccgagcgggagaaggtggacgcgatcgacggcgagtaccgcctccgcggggaggcccgcaagacgttcgtggacctgatgcggcgcggcgacctgcccgtctggctcgcctaccgggtggccgccgaggggatcaactacgcggaccgccggtggtgcttcgacggcatcaagaacaaccagatcctggaggagaacgtggaggtcgagatctggaccaaggagggggagcgcaagaagctgaagccgcggtggctcgacgcccgcatctacagcgaccccctggccctgaaggagttcaaggagttcgccgcgggccggaagtccctcaccctgaacctgatcaccgagatgggccgcctccccacgttcatgacccagaaggcccgggacgccctggacaacctggccgtgctccacaccgccgaggtcgggggccgcgcgtacaaccacgccctgagcgagctgcccgagaccctcgagacgctgctgctcctgaccctgctcgccaccgtgaccgggggcatcttcctgttcctgatgtccggcaaggggatcggcaagatgacgctcgggatgtgctgcatcatcaccgccagcatcctgctgtggtacgcccagatccagccgcactggatcgcggcctccatcatcctcgagttcttcctgatcgtgctgctcatccccgagcccgagaagcagcggacgccccaggacaaccagctgacctacgtcgtgatcgccatcctgaccgtggtcgccgccacgatggcgaacgagatgggcttcctcgagaagaccaagaaggacctggggctgggcagcatcatcacccaggagagcgagtccaacatcctcgacatcgacctgcgcccggccagcgcctggaccctgtacgccgtggccacgaccttcgtgacccccatgctccggcactccatcgagaacagctccgtcaacgtgagcctgaccgcgatcgccaaccaggccacggtgctgatgggcctcgggcgcggctggcccctgtccaagatggacatcggggtccccctgctcgccatcggctgctacagccaggtgaacccgatcaccctgaccgcggccctgctcctgctggtggcccactacgccatcatcgggcccggcctccaggccaaggcgacccgcgaggcccagaagcgggccgccgccggcatcatgaagaaccccacggtcgacgggatcaccgtgatcgacctggagcccatcccgtacgaccccaagttcgagaagcagctgggccaggtgatgctcctggtcctgtgcgtgacccaggtgctcatgatgcgcaccacgtgggcgctgtgcgaggccctgaccctcgccaccgggcccatctccaccctgtgggagggcaaccccgggcggttctggaacacgaccatcgccgtcagcatggccaacatcttccgcggctcctacctggcgggcgccgggctcctgttcagcatcatgaagaacaccaccaacacgcggcgcggcaccgggaacatcggcgagaccctgggcgagaagtggaagtcccggctcaacgccctgggcaagagcgagttccagatctacaagaagtccggcatccaggaggtggaccgcaccctggccaaggaggggatcaagcggggcgagacggaccaccacgcggtgagccgcgggtccgccaagctccggtggttcgtcgagcgcaacatggtgaccccggagggcaaggtggtcgacctgggctgcgggcggggcgggtggagctactactgcggcgggctgaagaacgtgcgcgaggtgaagggcctcaccaagggcgggcccggccacgaggagcccatccccatgtccacctacgggtggaacctggtccggctgcagagcggcgtggacgtgttcttcacgccgcccgagaagtgcgacaccctcctgtgcgacatcggggagagctcccccaaccccaccatcgaggccggccgcaccctgcgggtcctcaacctggtggagaactggctgaacaacaacacgcagttctgcatcaaggtgctcaacccgtacatgcccagcgtcatcgagaagatggagaccctgcagcgcaagtacggcggggccctggtgcggaaccccctgtcccgcaacagcacccacgagatgtactgggtgtccaacgccaccggcaacatcgtcagctccgtgaacatgatcagccgcatgctcatcaaccggttcaccatgaagcacaagaaggcgacgtacgagccggacgtggacctggggtccggcacccgcaacatcgggatcgagaacgagatccccaacctggacatcatcggcaagcggatcgagaagatcaagcaggagcacgagaccagctggcactacgaccaggaccacccctacaagacctgggcctaccacggctcctacgagacgaagcagaccgggagcgcctccagcatggtcaacggcgtggtgcgcctcctgaccaagccctgggacgtcgtgccgatggtgacccagatggccatgacggacaccacccccttcgggcagcagcgggtcttcaaggagaaggtggacacccgcacgcaggagcccaaggagggcaccaagaagctgatgcggatcaccgccgagtggctctggaaggagctgggcaagaagaagacgccccgcatgtgcacgcgggaggagttcacccgcaaggtgcggtccaacgcggccctgggggccatcttcaccgacgagaacaagtggaagtccgcccgcgaggccgtcgaggactcccggttctgggagctcgtggaccgcgagcggaacctgcacctggagggcaagtgcgagacctgcgtctacaacatgatggggaagcgcgagaagaagctcggcgagttcgggaaggcgaagggcagccgggccatctggtacatgtggctgggcgcccgcttcctggagttcgaggccctcgggttcctgaacgaggaccactggttctcccggggcaacagcctgagcggggtggagggcgaggggctccacaagctgggctacatcctgcgcgacgtgtccaagaaggagggcggggcgatgtacgccgacgacacggccggctgggacacccggatcaccctcgaggacctgaagaacgaggagatggtcaccaaccacatgaagggggagcacaagaagctggccgaggccatcttcaagctcacgtaccagaacaaggtggtgcgcgtccagcgcccgacgccccggggcaccgtgatggacatcatcagccgcaaggaccagcgggggtccggccaggtgggcacctacgggctgaacacgttcaccaacatggaggcgcagctgatccgccagatggagggcgaggggatcttcaagagcatccagcacctcaccgtcaccgaggagatcgccgtgcggaactggctggcccgcgtgggccgggagcgcctgtcccggatggccatcagcggcgacgactgcgtcgtgaagcccctcgacgaccgcttcgcctccgcgctgacggccctgaacgacatggggaaggtgcggaaggacatccagcagtgggagcccagccgcggctggaacgactggacccaggtcccgttctgctcccaccacttccacgagctcgtgatgaaggacgggcgggtgctggtcgtgccctgccgcaaccaggacgagctgatcggccgggcccgcatcagccagggggccggctggtccctcaaggagaccgcctgcctgggcaagagctacgcgcagatgtggaccctgatgtacttccaccggcgcgacctccggctggccgccaacgccatctgctccgccgtgcccagccactgggtccccacgtcccgcaccacctggagcatccacgcgaagcacgagtggatgaccaccgaggacatgctggccgtgtggaaccgcgtgtggatccaggagaacccgtggatggaggacaagacgcccgtcgagtcctgggaggaggtgccctacctcgggaagcgggaggaccagtggtgcggcagcctgatcgggctgaccagccgcgccacctgggccaagaacatccagaccgcgatcaaccaggtgcggtccctcatcggcaacgaggagtacacggactacatgcccagcatgaagcgcttccggaaggaggaggaggaggccggggtcctgtggtga

SEQ ID NO: 9404 - RNA, 9876 nt, synthetic construct
  misc_feature 1..9876: note = derived and/or modified CDS sequence (opt1) from DENV-2__EU596487__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcgggccgccgccgggatcatgaagaaccccaccgtggacggcatcaccgtgatcgacctcgagcccatcccgtacgaccccaagttcgagaagcagctggggcaggtcatgctgctcgtgctgtgcgtgacccaggtcctgatgatgcgcacgacctgggcgctctgcgaggccctgaccctggccaccggccccatcagcacgctctgggaggggaaccccggccggttctggaacaccaccatcgccgtgtccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacgtacggctggaacctcgtgcggctgcagagcggggtggacgtcttcttcaccccgcccgagaagtgcgacaccctgctctgcgacatcggcgagtccagccccaaccccaccatcgaggccggccgcacgctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcacgatgaagcacaagaaggcgacctacgagccggacgtcgacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtggtcaagctgctcaccaagccctgggacgtggtgccgatggtcacgcagatggccatgaccgacaccacccccttcggccagcagcgcgtgttcaaggagaaggtggacacgcggacccaggagcccaaggagggcaccaagaagctgatgcgcatcaccgccgagtggctgtggaaggagctcgggaagaagaagacgccccggatgtgcacccgcgaggagttcacccggaaggtccgcagcaacgcggccctgggcgccatcttcaccgacgagaacaagtggaagtccgcccgggaggccgtggaggacagccgcttctgggagctggtcgaccgggagcgcaacctccacctggaggggaagtgcgagacgtgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtcagcaagaaggagggcggcgcgatgtacgccgacgacaccgccgggtgggacacccgcatcaccctggaggacctcaagaacgaggagatggtgacgaaccacatgaagggcgagcacaagaagctggccgaggccatcttcaagctgacctaccagaacaaggtggtccgggtgcagcgcccgacgccccgggggaccgtgatggacatcatctcccggaaggaccagcgcggcagcggccaggtcgggacgtacggcctcaacaccttcaccaacatggaggcgcagctgatccggcagatggagggggagggcatcttcaagtccatccagcgcctgaccgtgacggaggagatcgccgtgcagaactggctcgcccgggtcggccgcgagcggctgagccgcatggccatctccggggacgactgcgtggtgaagcccctggacgaccggttcgccagcgcgctcaccgccctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgccggctggagcctgaaggagaccgcctgcctcgggaagtcctacgcgcagatgtggacgctgatgtacttccaccgccgggacctgcgcctcgccgccaacgccatctgcagcgccgtcccctcccactgggtgcccaccagccggaccacctggtccatccacgcgaagcacgagtggatgaccacggaggacatgctggccgtgtggaaccgcgtctggatccaggagaacccgtggatggaggacaagacccccgtggagagctgggaggaggtgccctacctgggcaagcgcgaggaccagtggtgcgggagcctcatcggcctgacctcccgggccacctgggccaagaacatccagacggcgatcaaccaggtccgcagcctgatcgggaacgaggagtacaccgactacatgccctccatgaagcggttccgcaaggaggaggaggaggccggcgtgctctggtga

SEQ ID NO: 9405 - RNA, 9876 nt, synthetic construct
  misc_feature 1..9876: note = derived and/or modified CDS sequence (opt1) from DENV-2__EU569713__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggctccgacaccgggaagcacggcaaggagatcaagatcaccccgcagagctccatcaccgaggccgagctcaccgggtacggcacggtgaccatggagtgcagcccccgcaccggcctggacttcaacgagatggtgctgctccagatggaggacaaggcctggctggtccaccggcagtggttcctggacctccccctgccctggctgccgggggccgacacccagggctccaactggatccagaaggagacgctcgtgaccttcaagaacccccacgcgaagaagcaggacgtggtcgtgctggggagccaggagggcgccatgcacaccgccctgaccggggccacggagatccagatgagctccggcaacctcctgttcaccggccacctgaagtgccgcctccggatggacaagctgcagctgaaggggatgagctactccatgtgcaccggcaagttcaagatcgtcaaggagatcgccgagacccagcacgggacgatcgtgatccgcgtgcagtacgagggcgacggcagcccctgcaagatccccttcgagatcatggacctcgagaagcggtacgtcctggggcgcctgatcaccgtgaacccgatcgtgaccgagaaggactcccccgtcaacatcgaggcggagccgcccttcggcgacagctacatcatcatcggggtggagccgggccagctcaagctgaactggttcaagaaggggtccagcatcggccagatgttcgagaccacgatgcgcggcgccaagcggatggccatcctgggggacaccgcctgggacttcggctccctcgggggcgtgttcaccagcatcgggaaggccctgcaccaggtcttcggcgcgatctacggcgccgccttctccggggtgagctggaccatgaagatcctgatcggcgtgatcatcacgtggatcgggatgaactcccgcagcacctccctgagcgtctccctcgtgctggtgggcgtcgtgaccctgtacctcggggtgatggtccaggccgacagcggctgcgtggtgtcctggaagaacaaggagctgaagtgcggcagcgggatcttcatcaccgacaacgtccacacgtggaccgagcagtacaagttccagcccgagagcccctccaagctggcgagcgccatccagaaggcccacgaggagggcatctgcgggatccggtccgtgacccgcctcgagaacctgatgtggaagcagatcacccccgagctgaaccacatcctcagcgagaacgaggccaagctgacgatcatgaccggcgacatcaaggggatcatgcaggccggcaagcggtccctgcgcccgcagcccaccgagctcaagtacagctggaagacctggggcaaggcgaagatgctgtccacggagagccacaaccagaccttcctgatcgacgggcccgagaccgccgagtgcccgaacaccaaccgggcctggaactccctcgaggtggaggactacggcttcggggtcttcagcacgaacatctggctgaagctgcgcgagaagcaggacgtgttctgcgactccaagctcatgagcgccgccatcaaggacaaccgggcggtgcacgccgacatgggctactggatcgagtccgccctgaacgacacctggaagatggagaaggccagcttcatcgaggtcaagtcctgccactggcccaagagccacaccctgtggtccaacggcgtgctcgagagcgagatgatcatccccaagaacttcgccgggcccgtgagccagcacaactaccgcccgggctaccacacccagaccgcggggccctggcacctgggcaagctggagatggacttcgacttctgcgaggggacgaccgtcgtggtgaccgaggactgcggcaaccggggcccctccctccgcaccacgaccgccagcgggaagctgatcaccgagtggtgctgccggtcctgcaccctgcccccgctccgctaccggggcgaggacgggtgctggtacggcatggagatccgccccctgaaggagaaggaggagaacctggtcaacagcctcgtgacggccgggcacggccagatcgacaacttctccctgggcgtgctggggatggccctcttcctggaggagatgctgcggacccgcgtcggcaccaagcacgcgatcctcctggtggccgtgagcttcgtcaccctgatcacggggaacatgtccttccgggacctcggccgcgtgatggtgatggtcggggccaccatgaccgacgacatcggcatgggcgtgacctacctggccctgctcgccgcgttcaaggtgcgccccacgttcgccgccgggctgctgctccggaagctgaccagcaaggagctgatgatggccaccatcggcatcgccctcctgtcccagagcaccatccccgagacgatcctggagctcaccgacgcgctggccctggggatgatggtcctcaagatcgtgcgcaacatggagaagtaccagctggccgtgaccatcatggccatcctgtgcgtcccgaacgccgtgatcctccagaacgcgtggaaggtgtcctgcaccatcctggccgccgtcagcgtgagccccctgctcctgacgagctcccagcagaaggccgactggatccccctggcgctcaccatcaagggcctgaaccccaccgccatcttcctgaccacgctcagccggacctccaagaagcgcagctggccgctgaacgaggccgtcatggccgtgggcatggtgtccatcctggccagcagcctcctgaagaacgacatccccatgaccgggcccctggtcgcgggcgggctcctgaccgtgtgctacgtgctgacgggccggtccgccgacctcgagctggagcgcgccgccgacgtcaagtgggaggaccaggccgagatcagcgggtccagccccatcctgtccatcaccatcagcgaggacggctccatgagcatcaagaacgaggaggaggagcagaccctcaccatcctgatccggacgggcctgctcgtgatctccggggtgttcccggtcagcatccccatcaccgcggccgcctggtacctgtgggaggtgaagaagcagcgcgccggcgtgctgtgggacgtccccagcccgccgcccgtggggaaggccgagctcgaggacggcgcgtaccggatcaagcagcgcgggatcttcggctacagccagatcggcgccggggtgtacaaggagggcaccttccacaccatgtggcacgtcacccgcggggccgtgctgatgcaccgcggcaagcggatcgagccctcctgggccgacgtgaagaaggacctgatcagctacgggggcggctggaagctcgagggggagtggaaggagggcgaggaggtccaggtgctggccctggagcccgggaagaacccccgcgcggtgcagacgaagcccggcctcttcaagaccaacaccgggaccatcggcgccgtctccctggacttcagccccggcacgtccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctgcgcaccctcatcctggccccgacccgcgtggtcgcggccgagatggaggaggccctgcgggggctccccatccgctaccagacccccgccatccgggccgagcacacgggccgcgagatcgtggacctgatgtgccacgcgaccttcaccatgcggctgctctcccccgtgcgcgtcccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggcgggcaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggggccaacttccgggcggagcgcgtcatcgacccccggcgctgcatgaagcccgtgatcctgaccgacggcgaggagcgggtgatcctggccgggcccatgccggtcacccacagctccgccgcccagcgccgcggccggatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtggacgccatcgacggggagtaccgcctccggggcgaggcccgcaagacgttcgtggacctgatgcggcgcggggacctgcccgtctggctcgcctaccgggtggccgcggagggcatcaactacgccgaccgccggtggtgcttcgacgggatcaagaacaaccagatcctggaggagaacgtggaggtcgagatctggaccaaggagggcgagcgcaagaagctgaagccgcggtggctcgacgcccgcatctactccgaccccctggccctgaaggagttcaaggagttcgcggccggccgcaagagcctcaccctgaacctgatcaccgagatggggcgcctccccacgttcatgacccagaaggcccgggacgccctggacaacctggccgtgctccacaccgcggaggtcggcgggcgcgcctacaaccacgccctgtccgagctgcccgagaccctcgagacgctgctgctcctgaccctgctcgccaccgtgaccggcggcatcttcctgttcctgatgagcgggaagggcatcgggaagatgacgctcggcatgtgctgcatcatcaccgcctccatcctgctgtggtacgcgcagatccagccgcactggatcgccgccagcatcatcctcgagttcttcctgatcgtgctgctcatccccgagcccgagaagcagcggacgccccaggacaaccagctgacctacgtcgtgatcgccatcctgaccgtggtcgccgcgacgatggccaacgagatggggttcctcgagaagaccaagaaggacctgggcctgggcagcatcatcacccaggagtccgagagcaacatcctcgacatcgacctgcgcccggcctccgcctggaccctgtacgccgtggcgacgaccttcgtgacccccatgctccggcacagcatcgagaactccagcgtcaacgtgtccctgaccgccatcgccaaccaggccacggtgctgatggggctcggccgcgggtggcccctgagcaagatggacatcggcgtccccctgctcgcgatcgggtgctactcccaggtgaacccgatcaccctgaccgccgccctgctcctgctggtggcccactacgccatcatcggccccggcctccaggcgaaggccacccgcgaggcccagaagcgggccgccgcggggatcatgaagaaccccacggtcgacggcatcaccgtgatcgacctggagcccatcccgtacgaccccaagttcgagaagcagctgggccaggtgatgctcctggtcctgtgcgtgacccaggtgctcatgatgcgcaccacgtgggccctgtgcgaggccctgaccctcgccaccggccccatcagcaccctgtgggaggggaaccccggccggttctggaacacgaccatcgccgtctccatggcgaacatcttccgcggcagctacctggccggggccggcctcctgttctccatcatgaagaacaccaccaacacgcggcgcgggaccggcaacatcggcgagaccctgggggagaagtggaagtcccggctcaacgccctgggcaagtccgagttccagatctacaagaagtccgggatccaggaggtggaccgcaccctggcgaaggagggcatcaagcgcggggagacggaccaccacgccgtgtcccgcggcagcgccaagctccggtggttcgtcgagcgcaacatggtgaccccggagggcaaggtggtcgacctggggtgcggccgcggcgggtggtcctactactgcggcgggctgaagaacgtgcgcgaggtgaaggggctcaccaagggcgggcccgggcacgaggagcccatccccatgagcacctacggctggaacctggtccggctgcagagcggggtggacgtgttctacacgccgcccgagaagtgcgacaccctcctgtgcgacatcggcgagtccagccccaaccccaccatcgaggccggccgcaccctgcgggtcctcaacctggtggagaactggctgaacaacaacacgcagttctgcatcaaggtgctcaacccgtacatgccctccgtcatcgagaagatggagaccctgcagcgcaagtacgggggcgccctggtgcggaaccccctgagccgcaactccacccacgagatgtactgggtgagcaacgcgaccgggaacatcgtctccagcgtgaacatgatctcccgcatgctcatcaaccggttcaccatgaagcacaagaaggccacgtacgagccggacgtggacctgggcagcgggacccgcaacatcggcatcgagaacgagatccccaacctggacatcatcggcaagcggatcgagaagatcaagcaggagcacgagacctcctggcactacgaccaggaccacccctacaagacctgggcctaccacgggagctacgagacgaagcagaccggctccgccagctccatggtcaacggggtggtgcgcctcctgaccaagccctgggacgtcgtgccgatggtgacccagatggccatgacggacaccacccccttcggccagcagcgggtcttcaaggagaaggtggacacccgcacgcaggagcccaaggagggcaccaagaagctgatgcggatcaccgcggagtggctctggaaggagctggggaagaagaagacgccccggatgtgcacgcgggaggagttcacccgcaaggtgcggagcaacgccgccctgggcgccatcttcaccgacgagaacaagtggaagtccgcccgcgaggcggtcgaggacagccggttctgggagctcgtggaccgcgagcggaacctgcacctggaggggaagtgcgagacctgcgtctacaacatgatgggcaagcgcgagaagaagctcggggagttcggcaaggccaagggctcccgggccatctggtacatgtggctgggggcccgcttcctggagttcgaggcgctcggcttcctgaacgaggaccactggttcagccgggggaacagcctgtccggcgtggagggggagggcctccacaagctgggctacatcctgcgcgacgtgagcaagaaggagggcggggccatgtacgccgacgacacggccgggtgggacacccggatcaccctcgaggacctgaagaacgaggagatggtcaccaaccacatgaagggcgagcacaagaagctggccgaggcgatcttcaagctcacgtaccagaacaaggtggtgcgcgtccagcgcccgacgccccgggggaccgtgatggacatcatctcccgcaaggaccagcggggcagcggccaggtggggacctacggcctgaacacgttcaccaacatggaggcccagctgatccgccagatggagggggagggcatcttcaagtccatccagcacctcaccgtcaccgaggagatcgccgtgcagaactggctggcccgggtgggccgcgagcggctgagccgcatggccatctccggggacgactgcgtcgtgaagcccctcgacgaccggttcgcgagcgccctgacggccctgaacgacatgggcaaggtgcgcaaggacatccagcagtgggagccctcccgggggtggaacgactggacccaggtcccgttctgcagccaccacttccacgagctcgtgatgaaggacggccgcgtgctggtcgtgccctgccggaaccaggacgagctgatcgggcgcgcccggatctcccagggcgccggctggagcctcaaggagaccgcgtgcctggggaagtcctacgcccagatgtggaccctgatgtacttccaccgccgggacctccgcctggccgccaacgccatctgcagcgcggtgccctcccactgggtccccacgagccggaccacctggtccatccacgccaagcacgagtggatgaccaccgaggacatgctggccgtgtggaaccgcgtgtggatccaggagaacccgtggatggaggacaagacgcccgtcgagagctgggaggaggtgccctacctcggcaagcgcgaggaccagtggtgcgggagcctgatcggcctgacctcccgggccacctgggcgaagaacatccagaccgccatcaaccaggtgcgcagcctcatcgggaacgaggagtacacggactacatgccctccatgaagcggttccgcaaggaggaggagaaggccggcgtcctgtggtga

SEQ ID NO: 9406 - RNA, 9876 nt, synthetic construct
  misc_feature 1..9876: note = derived and/or modified CDS sequence (opt1) from DENV-2__EU569714__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgtgatcctcctggtcgccgtgtccttcgtgaccctgatcacggggaacatgagcttccgggacctcggccgcgtcatggtgatggtgggggcgaccatgaccgacgacatcggcatgggcgtcacctacctggccctgctcgccgccttcaaggtgcgccccacgttcgccgcggggctgctgctccggaagctgacctccaaggagctgatgatggccaccatcggcatcgccctcctgagccagtccaccatccccgagacgatcctggagctcaccgacgccctggccctggggatgatggtgctcaagatcgtccgcaacatggagaagtaccagctggcggtgaccatcatggccatcagctgcgtgccgaacgccgtcatcctgcagaacgcctggaaggtgtcctgcaccatcctcgccgtcgtgagcgtgagccccctgctgctcacgagctcccagcagaaggcggactggatccccctggccctgaccatcaagggcctcaaccccaccgccatcttcctgaccacgctgagccggacctccaagaagcgcagctggccgctcaacgaggccgtcatggcggtgggcatggtgtccatcctggccagcagcctgctcaagaacgacatccccatgaccgggcccctggtcgccggcgggctgctcaccgtgtgctacgtgctgacgggccggtccgccgacctggagctcgagcgcgccgcggacgtcaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtgttcccggtcagcatccccatcaccgccgccgcctggtacctctgggaggtgaagaagcagcgcgcgggcgtgctgtgggacgtccccagcccgccgcccgtggggaaggccgagctggaggacggcgcctaccggatcaagcagcgcgggatcttcggctacagccagatcggcgccggggtgtacaaggagggcaccttccacaccatgtggcacgtcacccgcggggccgtgctcatgcaccgcggcaagcggatcgagccctcctgggcggacgtgaagaaggacctgatcagctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgccgtctccctcgacttcagccccggcacgtccgggagccccatcgtggaccggaagggcaaggtggtcgggctgtacggcaacggcgtggtgacccgctccggggcctacgtcagcgcgatcgcccagaccgagaagtccatcgaggacaaccccgagatcgaggacgacatcttccggaagaagcgcctgaccatcatggacctccaccccggcgccgggaagacgaagcggtacctgcccgccatcgtgcgcgaggcgatcaagcggggcctgcgcaccctgatcctcgccccgacccgcgtggtcgccgccgagatggaggaggccctgcgggggctgcccatccgctaccagacccccgcgatccgggccgagcacacgggccgcgagatcgtggacctcatgtgccacgccaccttcaccatgcggctgctgtcccccgtgcgcgtcccgaactacaacctcatcatcatggacgaggcccacttcaccgaccccgccagcatcgcggcccggggctacatctccacgcgcgtggagatgggggaggccgccggcatcttcatgaccgccacgccgcccgggagccgggacccgttcccccagtccaacgcgcccatcatggacgaggagcgcgagatccccgagcggagctggaactccggccacgagtgggtgaccgacttcaaggggaagacggtctggttcgtgccgagcatcaaggccggcaacgacatcgccgcctgcctgcgcaagaacggcaagaaggtgatccagctgtcccggaagaccttcgacagcgagtacgtcaagacccgcgcgaacgactgggacttcgtggtgaccacggacatctccgagatgggggccaacttccgggccgagcgcgtcatcgacccccggcgctgcatgaagcccgtgatcctcaccgacggcgaggagcgggtgatcctggccgggcccatgccggtcacccacagctccgccgcgcagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgccatcgacggggagtaccgcctgcggggcgaggcccgcaagacgttcgtggacctcatgcggcgcggggacctgcccgtctggctggcgtaccgggtggccgccgagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgcgctgaaggagttcaaggagttcgccgccggccggaagtccctgaccctcaacctgatcaccgagatggggcgcctgcccacgttcatgacccagaaggcccgggacgcgctcgacaacctggccgtgctgcacaccgccgaggtcggcgggcgcgcctacaaccacgccctctccgagctgcccgagaccctggagacgctcctgctgctcaccctgctggcggccgtgaccggcggcatcttcctcttcctgatgagcgggaagggcatcgggaagatgaccctgggcatgtgctgcatcatcacggcctccatcctcctgtggtacgcccagatccagccgcactggatcgccgcgagcatcatcctggagttcttcctcatcgtgctgctgatccccgagcccgagaagcagcggacgccccaggacaaccagctcacctacgtcgtgatcgccatcctgaccgtggtcgccgccaccatggccaacgagatggggttcctggagaagacgaagaaggacctcggcctgggcagcatcatcacccaggagtccgagagcaacatcctggacatcgacctccgcccggcgtccgcctggaccctgtacgccgtggccaccacgttcgtgacccccatgctgcggcacagcatcgagaactccagcgtcaacgtgtccctcaccgccatcgcgaaccaggccaccgtgctgatggggctgggccgcgggtggcccctcagcaagatggacatcggcgtccccctgctggccatcgggtgctactcccaggtgaacccgatcacgctcaccgccgcgctgctgctcctggtggcccactacgccatcatcggccccggcctgcaggccaaggccacccgcgaggcgcagaagcgggccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgacgctggccaccggccccatcagcaccctctgggaggggaaccccggccggttctggaacaccacgatcgccgtctccatggccaacatcttccgcggcagctacctggccggggcgggcctcctcttctccatcatgaagaacaccaccaacacccggcgcgggacgggcaacatcggcgagaccctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgcgaagctgcggtggttcgtcgagcgcaacatggtgacgccggagggcaaggtggtcgacctcgggtgcggccgcggcgggtggtcctactactgcggcgggctgaagaacgtgcgcgaggtgaaggggctgaccaagggcgggcccgggcacgaggagcccatccccatgagcacctacggctggaacctcgtccggctgcagagcggggtggacgtgttcttcaccccgcccgagaagtgcgacacgctgctctgcgacatcggcgagtccagccccaaccccaccatcgaggccggccgcaccctgcgggtcctgaacctcgtggagaactggctgaacaacaacacccagttctgcatcaaggtgctgaacccgtacatgccctccgtcatcgagaagatggagacgctccagcgcaagtacgggggcgccctggtgcggaaccccctgagccgcaactccacccacgagatgtactgggtgagcaacgccaccgggaacatcgtctccagcgtgaacatgatctcccgcatgctgatcaaccggttcaccatgaagcacaagaaggccacctacgagccggacgtggacctcggcagcgggacgcgcaacatcggcatcgagaacgagatccccaacctggacatcatcggcaagcggatcgagaagatcaagcaggagcacgagacctcctggcactacgaccaggaccacccctacaagacctgggcgtaccacgggagctacgagaccaagcagacgggctccgccagctccatggtcaacggggtggtgcgcctgctcaccaagccctgggacgtcgtgccgatggtgacccagatggccatgaccgacacgacccccttcggccagcagcgggtcttcaaggagaaggtggacacccgcacccaggagcccaaggagggcacgaagaagctgatgcggatcaccgccgagtggctgtggaaggagctcgggaagaagaagacgccccggatgtgcacccgggaggagttcacgcgcaaggtccggagcaacgccgcgctgggcgccatcttcaccgacgagaacaagtggaagtccgcccgcgaggccgtggaggacagccggttctgggagctggtggaccgcgagcggaacctccacctggaggggaagtgcgagacctgcgtctacaacatgatgggcaagcgcgagaagaagctgggggagttcggcaaggccaagggctcccgggcgatctggtacatgtggctcggggcccgcttcctggagttcgaggccctgggcttcctcaacgaggaccactggttcagccgggggaacagcctgtccggcgtggagggggagggcctgcacaagctcggctacatcctgcgcgacgtgagcaagaaggagggcggggccatgtacgcggacgacaccgccgggtgggacacgcggatcaccctggaggacctcaagaacgaggagatggtcaccaaccacatgaagggcgagcacaagaagctggccgaggccatcttcaagctgacctaccagaacaaggtggtgcgcgtccagcgcccgacgccccgggggaccgtgatggacatcatctcccgcaaggaccagcggggcagcggccaggtggggacctacggcctcaacaccttcacgaacatggaggcccagctgatccgccagatggagggggagggcatcttcaagtccatccagcacctgaccgtcaccgaggagatcgcggtgcagaactggctcgcccgggtgggccgcgagcggctgagccgcatggccatctccggggacgactgcgtcgtgaagcccctggacgaccggttcgccagcgccctcaccgcgctgaacgacatgggcaaggtgcgcaaggacatccagcagtgggagccctcccgggggtggaacgactggacgcaggtcccgttctgcagccaccacttccacgagctggtgatgaaggacggccgcgtgctcgtcgtgccctgccggaaccaggacgagctgatcgggcgcgcccggatctcccagggcgccggctggagcctgaaggagaccgcctgcctcgggaagtcctacgcccagatgtggaccctgatgtacttccaccgccgggacctgcgcctcgcggccaacgccatctgcagcgccgtgccctcccactgggtccccaccagccggacgacctggtccatccacgccaagcacgagtggatgaccaccgaggacatgctggcggtgtggaaccgcgtgtggatccaggagaacccgtggatggaggacaagacccccgtcgagagctgggaggaggtgccctacctgggcaagcgcgaggaccagtggtgcgggagcctcatcggcctgacgtcccgggccacctgggccaagaacatccagaccgccatcaaccaggtgcgcagcctgatcgggaacgaggagtacaccgactacatgccctccatgaagcggttccgcaaggaggaggaggaggcgggcgtcctctggtga

SEQ ID NO: 9407 - RNA, 9876 nt, synthetic construct
  misc_feature 1..9876: note = derived and/or modified CDS sequence (opt1) from DENV-2__EU569715__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcgggccgccgccgggatcatgaagaaccccaccgtggacggcatcaccgtgatcgacctcgagcccatcccgtacgaccccaagttcgagaagcagctggggcaggtcatgctgctcgtgctgtgcgtgacccaggtcctgatgatgcgcacgacctgggcgctctgcgaggccctgaccctggccaccggccccatcagcacgctctgggaggggaaccccggccggttctggaacaccaccatcgccgtgtccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacgtacggctggaacctcgtgcggctgcagagcggggtggacgtcttcttcaccccgcccgagaagtgcgacaccctgctctgcgacatcggcgagtccagccccaaccccaccatcgaggccggccgcacgctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcacgatgaagcacaagaaggcgacctacgagccggacgtcgacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtggtcaagctgctcaccaagccctgggacgtggtgccgatggtcacgcagatggccatgaccgacaccacccccttcggccagcagcgcgtgttcaaggagaaggtggacacgcggacccaggagcccaaggagggcaccaagaagctgatgcgcatcaccgccgagtggctgtggaaggagctcgggaagaagaagacgccccggatgtgcacccgcgaggagttcacccggaaggtccgcagcaacgcggccctgggcgccatcttcaccgacgagaacaagtggaagtccgcccgggaggccgtggaggacagccgcttctgggagctggtcgaccgggagcgcaacctccacctggaggggaagtgcgagacgtgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtcagcaagaaggagggcggcgcgatgtacgccgacgacaccgccgggtgggacacccgcatcaccctggaggacctcaagaacgaggagatggtgacgaaccacatgaagggcgagcacaagaagctggccgaggccatcttcaagctgacctaccagaacaaggtggtccgggtgcagcgcccgacccccgggggcaccgtgatggacatcatctcccgcaaggaccagcggggcagcgggcaggtcggcacgtacgggctcaacaccttcaccaacatggaggcgcagctgatccgccagatggagggcgagggcatcttcaagtccatccagcggctgaccgtgacggaggagatcgccgtgcagaactggctcgcccgcgtcgggcgggagcgcctgagccggatggccatctccggcgacgactgcgtggtgaagcccctggacgaccgcttcgccagcgcgctcaccgccctgaacgacatggggaaggtccggaaggacatccagcagtgggagccctcccgcggctggaacgactggacccaggtgccgttctgcagccaccacttccacgagctggtgatgaaggacgggcgggtcctcgtggtgccctgccgcaaccaggacgagctgatcggccgggcccgcatctcccagggcgccgggtggagcctgaaggagaccgcctgcctcggcaagtcctacgcgcagatgtggacgctgatgtacttccaccggcgcgacctgcggctcgccgccaacgccatctgcagcgccgtcccctcccactgggtgcccaccagccgcaccacctggtccatccacgcgaagcacgagtggatgaccacggaggacatgctggccgtgtggaaccgggtctggatccaggagaacccgtggatggaggacaagacccccgtggagagctgggaggaggtgccctacctggggaagcgcgaggaccagtggtgcggcagcctcatcgggctgacctcccgcgccacctgggccaagaacatccagacggcgatcaaccaggtccggagcctgatcggcaacgaggagtacaccgactacatgccctccatgaagcgcttccggaaggaggaggaggaggccggcgtgctctggtga

SEQ ID NO: 9408 - RNA, 9876 nt, synthetic construct
  misc_feature 1..9876: note = derived and/or modified CDS sequence (opt1) from DENV-2__EU569716__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtgcagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcatctgcaagaagaacatggagggcaaggtcgtgctgcccgagaacctggagtacaccatcgtgatcacgccccacagcggggaggagcacgccgtcggcaacgacacggggaagcacggcaaggagatcaagatcaccccgcagtccagcatcaccgaggccgagctcaccgggtacggcaccgtgacgatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagaccctcgtgacgttcaagaacccccacgcgaagaagcaggacgtggtcgtgctggggtcccaggagggcgccatgcacaccgccctgaccggggccaccgagatccagatgagcagcggcaacctcctgttcacgggccacctgaagtgccgcctccggatggacaagctgcagctgaaggggatgtcctacagcatgtgcaccggcaagttcaagatcgtcaaggagatcgccgagacccagcacgggaccatcgtgatccgcgtgcagtacgagggcgacggctccccctgcaagatccccttcgagatcatggacctcgagaagcggtacgtcctggggcgcctgatcacggtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccaccatgcgcggcgccaagcggatggccatcctgggggacacggcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacctggatcgggatgaacagccgctccacgagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacctggacggagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgaccatcatgacgggcgacatcaaggggatcatgcaggccggcaagcggagcctgcgcccgcagcccaccgagctcaagtactcctggaagacctggggcaaggccaagatgctgagcaccgagtcccacaaccagacgttcctgatcgacgggcccgagaccgcggagtgcccgaacaccaaccgggcctggaacagcctcgaggtcgaggactacggcttcggggtgttctccaccaacatctggctgaagctgcgcgagaagcaggacgtgttctgcgacagcaagctcatgtccgccgccatcaaggacaaccgggccgtccacgcggacatgggctactggatcgagagcgccctgaacgacacgtggaagatggagaaggcctccttcatcgaggtcaagagctgccactggcccaagtcccacaccctgtggagcaacggcgtgctcgagtccgagatgatcatccccaagaacttcgccgggcccgtcagccagcacaactaccgcccgggctaccacacccagaccgccgggccctggcacctgggcaagctggagatggacttcgacttctgcgaggggaccacggtggtggtcaccgaggactgcggcaaccggggccccagcctccgcaccaccacggcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgaccgccgggcacggccagatcgacaacttcagcctgggcgtcctggggatggccctcttcctggaggagatgctgcggacgcgcgtgggcaccaagcacgccatcctcctggtggcggtctccttcgtgaccctgatcaccgggaacatgagcttccgggacctcggccgcgtgatggtcatggtgggggccacgatgaccgacgacatcggcatgggcgtgacctacctggccctgctcgccgccttcaaggtccgccccaccttcgcggccgggctgctgctccggaagctgacgtccaaggagctgatgatggccaccatcggcatcgccctcctgagccagtccaccatccccgagaccatcctggagctcacggacgccctggcgctggggatgatggtgctcaagatcgtgcgcaacatggagaagtaccagctggccgtcaccatcatggccatcctgtgcgtgccgaacgccgtgatcctccagaacgcctggaaggtcagctgcaccatcctggcggccgtgtccgtcagccccctgctcctgacctccagccagcagaaggccgactggatccccctggccctcacgatcaagggcctgaaccccaccgcgatcttcctgaccaccctctcccggacgagcaagaagcgctcctggccgctgaacgaggccgtgatggccgtgggcatggtcagcatcctggcctccagcctcctgaagaacgacatccccatgaccgggcccctggtggccggcgggctcctgaccgtgtgctacgtcctgaccggccggagcgcggacctcgagctggagcgcgccgccgacgtgaagtgggaggaccaggccgagatctccgggagctcccccatcctgagcatcacgatctccgaggacggcagcatgtccatcaagaacgaggaggaggagcagaccctcaccatcctgatccggaccggcctgctcgtgatcagcggggtcttcccggtgtccatccccatcacggccgcggcctggtacctgtgggaggtgaagaagcagcgcgccggcgtcctgtgggacgtgcccagcccgccgcccgtggggaaggccgagctcgaggacggcgcctaccggatcaagcagcgcgggatcttcggctactcccagatcggcgcgggggtctacaaggagggcaccttccacaccatgtggcacgtgacccgcggggccgtgctgatgcaccgcggcaagcggatcgagcccagctgggccgacgtcaagaaggacctgatctcctacgggggcggctggaagctcgagggggagtggaaggagggcgaggaggtccaggtgctggccctggagcccgggaagaacccccgcgccgtccagaccaagcccggcctcttcaagacgaacaccgggaccatcggcgcggtgagcctggacttctcccccggcaccagcgggtcccccatcgtggaccggaagggcaaggtcgtggggctgtacggcaacggcgtggtcacgcgcagcggggcctacgtgtccgccatcgcccagaccgagaagtccatcgaggacaaccccgagatcgaggacgacatcttccggaagaagcgcctcaccatcatggacctgcaccccggcgcggggaagaccaagcggtacctgcccgccatcgtgcgcgaggccatcaagcggggcctgcgcacgctcatcctggccccgacccgcgtcgtggccgcggagatggaggaggccctgcgggggctccccatccgctaccagacccccgccatccgggccgagcacaccggccgcgagatcgtggacctgatgtgccacgccacgttcaccatgcggctgctcagccccgtccgcgtgccgaactacaacctgatcatcatggacgaggcgcacttcaccgaccccgcctccatcgccgcccggggctacatcagcacccgcgtggagatgggggaggccgcgggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggccggcaacgacatcgcggcctgcctgcgcaagaacggcaagaaggtcatccagctcagccggaagacgttcgactccgagtacgtgaagacccgcgccaacgactgggacttcgtggtcaccaccgacatcagcgagatgggggccaacttccgggccgagcgcgtgatcgacccccggcgctgcatgaagcccgtgatcctgacggacggcgaggagcgggtcatcctggcggggcccatgccggtgacccactccagcgccgcccagcgccgcggccggatcgggcgcaaccccaagaacgagaacgaccagtacatctacatgggcgagcccctcgagaacgacgaggactgcgcccactggaaggaggccaagatgctgctggacaacatcaacacccccgagggcatcatcccgtccatgttcgagcccgagcgggagaaggtggacgcgatcgacggggagtaccgcctccggggcgaggcccgcaagaccttcgtcgacctgatgcggcgcggggacctgcccgtgtggctcgcctaccgggtggccgccgagggcatcaactacgcggaccgccggtggtgcttcgacgggatcaagaacaaccagatcctggaggagaacgtcgaggtggagatctggacgaaggagggcgagcgcaagaagctgaagccgcggtggctcgacgcccgcatctacagcgaccccctggccctgaaggagttcaaggagttcgccgcgggccggaagtccctcaccctgaacctgatcaccgagatggggcgcctccccaccttcatgacgcagaaggcccgggacgccctggacaacctggccgtcctccacaccgccgaggtgggcgggcgcgcgtacaaccacgccctgagcgagctgcccgagaccctcgagaccctgctgctcctgacgctgctcgccaccgtgaccggcggcatcttcctgttcctgatgtccgggaagggcatcgggaagatgaccctcggcatgtgctgcatcatcacggccagcatcctgctgtggtacgcccagatccagccgcactggatcgcggcctccatcatcctcgagttcttcctgatcgtcctgctcatccccgagcccgagaagcagcggacgccccaggacaaccagctgacctacgtggtgatcgccatcctgaccgtcgtggccgccaccatggcgaacgagatggggttcctcgagaagacgaagaaggacctgggcctgggcagcatcatcacccaggagagcgagtccaacatcctcgacatcgacctgcgcccggccagcgcctggaccctgtacgccgtggccaccacgttcgtcacccccatgctccggcactccatcgagaacagctccgtgaacgtgagcctgaccgcgatcgccaaccaggccaccgtcctgatggggctcggccgcgggtggcccctgtccaagatggacatcggcgtgcccctgctcgccatcgggtgctacagccaggtgaacccgatcacgctgaccgcggccctgctcctgctggtcgcccactacgccatcatcggccccggcctccaggccaaggcgacccgcgaggcccagaagcgggccgccgccgggatcatgaagaaccccaccgtggacggcatcacggtgatcgacctggagcccatcccgtacgaccccaagttcgagaagcagctggggcaggtcatgctcctggtgctgtgcgtgacccaggtcctcatgatgcgcaccacctgggcgctgtgcgaggccctgacgctcgccaccggccccatctccaccctgtgggaggggaaccccggccggttctggaacaccacgatcgccgtgagcatggccaacatcttccgcggctcctacctggcgggggccggcctcctgttcagcatcatgaagaacaccaccaacacccggcgcgggacgggcaacatcggcgagaccctgggggagaagtggaagtcccggctcaacgccctgggcaagagcgagttccagatctacaagaagtccgggatccaggaggtggaccgcaccctggccaaggagggcatcaagcgcggggagaccgaccaccacgcggtcagccgcggctccgccaagctccggtggttcgtggagcgcaacatggtgacgccggagggcaaggtcgtggacctggggtgcggccgcggcgggtggagctactactgcggcgggctgaagaacgtgcgcgaggtcaaggggctcaccaagggcgggcccgggcacgaggagcccatccccatgtccacctacggctggaacctggtgcggctgcagagcggggtggacgtcttcttcaccccgcccgagaagtgcgacacgctcctgtgcgacatcggcgagagctcccccaaccccaccatcgaggccggccgcaccctgcgggtgctcaacctggtggagaactggctgaacaacaacacccagttctgcatcaaggtcctcaacccgtacatgcccagcgtgatcgagaagatggagacgctgcagcgcaagtacgggggcgccctggtgcggaaccccctgtcccgcaacagcacccacgagatgtactgggtctccaacgccaccgggaacatcgtgagctccgtgaacatgatcagccgcatgctcatcaaccggttcaccatgaagcacaagaaggcgacctacgagccggacgtcgacctgggctccgggacgcgcaacatcggcatcgagaacgagatccccaacctggacatcatcggcaagcggatcgagaagatcaagcaggagcacgagaccagctggcactacgaccaggaccacccctacaagacctgggcctaccacgggtcctacgagaccaagcagacgggcagcgcctccagcatggtgaacggggtggtccgcctcctgaccaagccctgggacgtggtgccgatggtcacccagatggccatgaccgacacgacccccttcggccagcagcgggtgttcaaggagaaggtggacacccgcacccaggagcccaaggagggcacgaagaagctgatgcggatcaccgccgagtggctctggaaggagctggggaagaagaagacgccccggatgtgcacccgggaggagttcacgcgcaaggtccggtccaacgcggccctgggcgccatcttcaccgacgagaacaagtggaagtccgcccgcgaggccgtggaggactcccggttctgggagctcgtcgaccgcgagcggaacctgcacctggaggggaagtgcgagacctgcgtgtacaacatgatgggcaagcgcgagaagaagctcggggagttcggcaaggcgaagggcagccgggccatctggtacatgtggctgggggcccgcttcctggagttcgaggccctcggcttcctgaacgaggaccactggttctcccgggggaacagcctgagcggcgtggagggggagggcctccacaagctgggctacatcctgcgcgacgtctccaagaaggagggcggcgcgatgtacgccgacgacaccgccgggtgggacacgcggatcaccctcgaggacctgaagaacgaggagatggtgaccaaccacatgaagggcgagcacaagaagctggccgaggccatcttcaagctcacctaccagaacaaggtggtccgcgtgcagcgcccgacgccccgggggaccgtgatggacatcatcagccgcaaggaccagcggggctccggccaggtcgggacctacggcctgaacaccttcacgaacatggaggcgcagctgatccgccagatggagggggagggcatcttcaagagcatccagcacctcaccgtgaccgaggagatcgccgtgcagaactggctggcccgggtcggccgcgagcggctgtcccgcatggccatcagcggggacgactgcgtggtgaagcccctcgacgaccggttcgcctccgcgctgaccgccctgaacgacatgggcaaggtccgcaaggacatccagcagtgggagcccagccgggggtggaacgactggacccaggtgccgttctgctcccaccacttccacgagctcgtgatgaaggacggccgcgtcctggtggtgccctgccggagccaggacgagctgatcgggcgcgcccggatctcccagggcgccggctggagcctcaaggagaccgcctgcctggggaagtcctacgcgcagatgtggaccctgatgtacttccaccgccgggacctccgcctggccgccaacgccatctgcagcgccgtcccctcccactgggtgcccaccagccggacgacctggtccatccacgcgaagcacgagtggatgaccaccgaggacatgctggccgtgtggaaccgcgtctggatccaggagaacccgtggatggaggacaagacccccgtggagagctgggaggaggtgccctacctcggcaagcgcgaggaccagtggtgcgggagcctgatcggcctgacgtcccgggccacctgggccaagaacatccagaccgcgatcaaccaggtccgcagcctcatcgggaacgaggagtacaccgactacatgccctccatgaagcggttccgcaaggaggaggaggaggccggcgtgctgtggtga

SEQ ID NO: 9409 - RNA, 9876 nt, synthetic construct
  misc_feature 1..9876: note = derived and/or modified CDS sequence (opt1) from DENV-2__EU569717__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcgggccgccgccgggatcatgaagaaccccaccgtggacggcatcaccgtgatcgacctcgagcccatcccgtacgaccccaagttcgagaagcagctggggcaggtcatgctgctcgtgctgtgcgtgacccaggtcctgatgatgcgcacgacctgggcgctctgcgaggccctgaccctggccaccggccccatcagcacgctctgggaggggaaccccggccggttctggaacaccaccatcgccgtgtccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcgggcccgggcacgaggagcccatccccatgagcacgtacggctggaacctcgtgcggctgcagagcggggtggacgtcttcttcaccccgcccgagaagtgcgacaccctgctctgcgacatcggcgagtccagccccaaccccaccatcgaggccggccgcacgctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccaccgggaacatcgtgtccagcgtgaacatgatctcccgcatgctggtcaaccggttcacgatgaagcacaagaaggcgacctacgagccggacgtggacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtcgtgcgcctgctcaccaagccctgggacgtggtcccgatggtgacgcagatggccatgaccgacaccacccccttcggccagcagcgggtgttcaaggagaaggtcgacacgcgcacccaggagcccaaggagggcaccaagaagctgatgcggatcaccgccgagtggctgtggaaggagctcgggaagaagaagacgccccgcatgtgcacccgggaggagttcacccgcaaggtgcggagcaacgcggccctgggcgccatcttcaccgacgagaacaagtggaagtccgcccgcgaggccgtcgaggacagccggttctgggagctggtggaccgcgagcggaacctccacctggaggggaagtgcgagacgtgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaacagcctgtccggcgtcgagggggagggcctgcacaagctcggctacatcctgcgcgacgtgagcaagaaggagggcggcgcgatgtacgccgacgacaccgccgggtgggacacccggatcaccctggaggacctcaagaacgaggagatggtgacgaaccacatgaagggcgagcacaagaagctggccgaggccatcttcaagctgacctaccagaacaaggtcgtgcgcgtgcagcgcccgacgccccgggggaccgtcatggacatcatctcccgcaaggaccagcggggcagcggccaggtggggacgtacggcctcaacaccttcaccaacatggaggcgcagctgatccgccagatggagggggagggcatcttcaagtccatccagcggctgaccgtgacggaggagatcgccgtccagaactggctcgcccgcgtgggccgggagcgcctgagccggatggccatctccggggacgactgcgtggtcaagcccctggacgaccgcttcgccagcgcgctcaccgccctgaacgacatgggcaaggtgcggaaggacatccagcagtgggagccctcccgcgggtggaacgactggacccaggtgccgttctgcagccaccacttccacgagctggtcatgaaggacggccgggtgctcgtggtcccctgccgcaaccaggacgagctgatcgggcgggcccgcatctcccagggcgccggctggagcctgaaggagaccgcctgcctcgggaagtcctacgcgcagatgtggacgctgatgtacttccaccggcgcgacctgcggctcgccgccaacgccatctgcagcgccgtgccctcccactgggtgcccaccagccgcaccacctggtccatccacgcgaagcacgagtggatgaccacggaggacatgctggccgtctggaaccgcgtgtggatccaggagaacccgtggatggaggacaagacccccgtggagagctgggaggaggtcccctacctgggcaagcgggaggaccagtggtgcgggagcctcatcggcctgacctcccgcgccacctgggccaagaacatccagacggcgatcaaccaggtgcggagcctgatcgggaacgaggagtacaccgactacatgccctccatgaagcgcttccggaaggaggaggaggaggccggcgtgctctggtga

SEQ ID NO: 9410 - RNA, 9876 nt, synthetic construct
  misc_feature 1..9876: note = derived and/or modified CDS sequence (opt1) from DENV-2__EU569718__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagtacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacgtggaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgactccggctgcgtggtcagctggaagaacaaggagctgaagtgcggctccgggatcttcatcaccgacaacgtgcacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtcaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtggaggactacggcttcggggtgttctccacgaacatctggctgaagctgcgcgagaagcaggacgtcttctgcgacagcaagctcatgtccgccgccatcaaggacaaccgggccgtgcacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtcgtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtcacggccgggcacggccagatcgacaacttcagcctgggcgtgctggggatggccctcttcctggaggagatgctgcggacccgcgtgggcaccaagcacgccatcctcctggtcgcggtgtccttcgtgaccctgatcacggggaacatgagcttccgggacctcggccgcgtcatggtgatggtgggggccaccatgaccgacgacatcggcatgggcgtcacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtccgcaacatggagaagtaccagctggccgtgaccatcatggccatcagctgcgtgccgaacgccgtcatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtcggcatggtgtccatcctggccagcagcctgctcaagaacgacatccccatgaccgggcccctggtggccggcgggctgctcaccgtctgctacgtgctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtcatctccggggtgttcccggtgagcatccccatcaccgccgcggcctggtacctctgggaggtcaagaagcagcgcgccggcgtgctgtgggacgtgcccagcccgccgcccgtcgggaaggccgagctggaggacggcgcctaccggatcaagcagcgcgggatcttcggctacagccagatcggcgcgggggtgtacaaggagggcaccttccacaccatgtggcacgtgacccgcggggccgtcctcatgcaccgcggcaagcggatcgagccctcctgggccgacgtgaagaaggacctgatcagctacgggggcggctggaagctggagggggagtggaaggagggcgaggaggtgcaggtcctcgccctggagcccgggaagaacccccgcgccgtgcagacgaagcccggcctgttcaagaccaacaccgggaccatcggcgcggtgtccctcgacttcagccccggcacgtccgggagccccatcgtcgaccggaagggcaaggtggtggggctgtacggcaacggcgtcgtgacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtccgcgaggccatcaagcggggcctgcgcaccctgatcctcgccccgacccgcgtggtggccgcggagatggaggaggccctgcgggggctgcccatccgctaccagacccccgccatccgggccgagcacacgggccgcgagatcgtcgacctcatgtgccacgccaccttcaccatgcggctgctgtcccccgtgcgcgtgccgaactacaacctcatcatcatggacgaggcgcacttcaccgaccccgccagcatcgccgcccggggctacatctccacgcgcgtcgagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtgtggttcgtcccgagcatcaaggccggcaacgacatcgcggcctgcctgcgcaagaacggcaagaaggtgatccagctgtcccggaagaccttcgacagcgagtacgtgaagacccgcgccaacgactgggacttcgtcgtgaccacggacatctccgagatgggggccaacttccgggccgagcgcgtgatcgacccccggcgctgcatgaagcccgtcatcctcaccgacggcgaggagcgggtgatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtcgacgcgatcgacggggagtaccgcctgcggggcgaggcccgcaagacgttcgtggacctcatgcggcgcggggacctgcccgtgtggctggcctaccgggtcgccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggtgggcgggaaggcgtacaaccacgccctctccgagctgcccgagaccctggagacgctcctgctgctcaccctgctggccaccgtcaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacctacgtggtcatcgccatcctgaccgtggtggccgccacgatggcgaacgagatggggttcctggagaagaccaagaaggacctcggcctgggcagcatcaccacccaggagtccgagagcaacatcctggacatcgacctccggccggcctccgcctggacgctgtacgccgtcgccaccaccttcgtgacccccatgctgcgccacagcatcgagaactccagcgtgaacgtctccctcacggcgatcgccaaccaggccaccgtgctgatggggctgggccgggggtggcccctcagcaagatggacatcggcgtgcccctgctggccatcgggtgctactcccaggtcaacccgatcaccctcaccgcggccctgctgctcctggtggcccactacgccatcatcggccccggcctgcaggccaaggcgacgcgcgaggcccagaagcgcgccgccgccgggatcatgaagaaccccaccgtggacggcatcaccgtcatcgacctcgagcccatcccgtacgaccccaagttcgagaagcagctgggccaggtgatgctgctcgtgctgtgcgtcacccaggtgctgatgatgcggacgacctgggcgctctgcgaggccctgaccctggccaccggccccatcagcacgctctgggaggggaaccccggccgcttctggaacaccaccatcgccgtgtccatggccaacatcttccggggcagctacctggcgggggccggcctcctcttctccatcatgaagaacaccacgaacacccgccgggggaccggcaacatcggcgagaccctgggggagaagtggaagtcccgcctgaacgccctcggcaagtccgagttccagatctacaagaagtccgggatccaggaggtcgaccggacgctggccaaggagggcatcaagcgcggggagaccgaccaccacgcggtgtcccggggcagcgccaagctgcgctggttcgtggagcggaacatggtcaccccggagggcaaggtggtggacctcgggtgcggccgcgggggctggtcctactactgcgggggcctgaagaacgtccgggaggtgaagggcctgaccaagggcgggcccgggcacgaggagcccatccccatgagcacgtacggctggaacctcgtgcgcctgcagagcggggtcgacgtgttcttcaccccgcccgagaagtgcgacaccctgctctgcgacatcggcgagtccagccccaaccccaccatcgaggccggccggacgctgcgcgtgctgaacctcgtcgagaactggctgaacaacaacacccagttctgcatcaaggtgctgaacccgtacatgccctccgtgatcgagaagatggagaccctccagcggaagtacgggggcgccctggtccgcaaccccctgagccggaactccacccacgagatgtactgggtgagcaacgccaccgggaacatcgtgtccagcgtcaacatgatctcccgcatgctgatcaaccgcttcacgatgaagcacaagaaggcgacctacgagccggacgtggacctcggcagcgggacccggaacatcggcatcgagaacgagatccccaacctggacatcatcggcaagcgcatcgagaagatcaagcaggagcacgagacctcctggcactacgaccaggaccacccctacaagacgtgggcctaccacgggagctacgagaccaagcagaccggctccgccagctccatggtgaacggggtcgtgcggctgctcaccaagccctgggacgtggtcccgatggtgacgcagatggccatgaccgacaccacccccttcggccagcagcgcgtgttcaaggagaaggtcgacacgcggacccaggagcccaaggagggcaccaagaagctgatgcgcatcaccgccgagtggctgtggaaggagctcgggaagaagaagacgccccggatgtgcacccgcgaggagttcacccggaaggtgcgcagcaacgcggccctgggcgccatcttcaccgacgagaacaagtggaagtccgcccgggaggccgtcgaggacagccgcttctgggagctggtggaccgggagcgcaacctccacctggaggggaagtgcgagacgtgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgggaacagcctgtccggcgtcgagggggagggcctgcacaagctcggctacatcctgcgggacgtgagcaagaaggagggcggggcgatgtacgccgacgacaccgccgggtgggacacccgcatcaccctggaggacctcaagaacgaggagatggtgacgaaccacatgaagggcgagcacaagaagctggccgaggccatcttcaagctgacctaccagaacaaggtcgtgcgggtgcagcgcccgacgccccgcgggaccgtcatggacatcatctcccggaaggaccagcgcggcagcggccaggtggggacgtacggcctcaacaccttcaccaacatggaggcgcagctgatccggcagatggagggggagggcatcttcaagtccatccagcgcctgaccgtgacggaggagatcgccgtccagaactggctcgcccgggtgggccgcgagcggctgagccgcatggccatctccggggacgactgcgtggtcaagcccctggacgaccggttcgccagcgcgctcaccgccctgaacgacatgggcaaggtgcgcaaggacatccagcagtgggagccctcccgggggtggaacgactggacccaggtgccgttctgcagccaccacttccacgagctggtcatgaaggacggccgcgtgctcgtggtcccctgccggaaccaggacgagctgatcgggcgcgcccggatctcccagggcgccggctggagcctgaaggagaccgcctgcctcgggaagtcctacgcgcagatgtggacgctgatgtacttccaccgccgggacctgcgcctcgccgccaacgccatctgcagcgccgtgccctcccactgggtgcccaccagccggaccacctggtccatccacgcgaagcacgagtggatgaccacggaggacatgctggccgtctggaaccgcgtgtggatccaggagaacccgtggatggaggacaagacccccgtggagagctgggaggaggtcccctacctgggcaagcgcgaggaccagtggtgcgggagcctcatcggcctgacctcccgggccacctgggccaagaacatccagacggcgatcaaccaggtgcgcagcctgatcgggaacgaggagtacaccgactacatgccctccatgaagcggttccgcaaggaggaggaggaggccggcgtgctctggtga

SEQ ID NO: 9411 - RNA, 9876 nt, synthetic construct
  misc_feature 1..9876: note = derived and/or modified CDS sequence (opt1) from DENV-2__EU596488__SS-prME
  source 1..9876: mol_type = other RNA
accgccggcgtgatcatcatgctgatccccaccgtcatggccttccacctcaccacccgcaacggggagccccacatgatcgtgggccggcaggagaaggggaagtccctgctgttcaagaccgaggacggcgtgaacatgtgcaccctcatggcgatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgccatcctggcgtacaccatcgggaccacccacttccagcgggccctcatcttcatcctgctgaccgccgtggcccccagcatgaccatgcgctgcatcggcatctccaaccgggacttcgtcgagggcgtgagcgggggctcctgggtggacatcgtcctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgccatgttcacgtgcaagaagaacatggagggcaaggtggtgctgcccgagaacctggagtacaccatcgtcatcacgccccacagcggggaggagcacgcggtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgccaagaagcaggacgtcgtggtcctggggtcccaggagggcgcgatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggccgagccgcccttcggcgactcctacatcatcatcggggtggagccgggccagctcaagctgaactggttcaagaaggggagctccatcggccagatgttcgagaccacgatgcgcggcgcgaagcggatggccatcctgggggacaccgcctgggacttcggcagcctcgggggcgtcttcacctccatcgggaaggccctgcaccaggtgttcggcgccatctacggcgcggccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgacaccggctgcgtggtctcctggaagaacaaggagctgaagtgcggcagcgggatcttcatcacggacaacgtgcacacctggaccgagcagtacaagttccagcccgagtcccccagcaagctggccagcgcgatccagaaggcccacgaggagggcatctgcgggatccggtccgtgacccgcctcgagaacctgatgtggaagcagatcacgcccgagctgaaccacatcctcagcgagaacgaggtcaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgccgagtgcccgaacacgaaccgggcgtggaactccctcgaggtggaggactacggcttcggggtgttcagcaccaacatctggctgaagctgcgcgagaagcaggacgtcttctgcgactccaagctcatgagcgccgccatcaaggacaaccgggccgtgcacgccgacatgggctactggatcgagtccgcgctgaacgacacctggaagatggagaaggccagcttcatcgagatcaagtcctgccactggcccaagagccacaccctgtggtccaacggcgtgctcgagagcgagatgatcatccccaagaacttcgccgggcccgtctcccagcacaactaccgcccgggctaccacacccagacggccgggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgcggggcacggccagatcgacaacttctccctgggcgtcctggggatggccctcttcctggaggagatgctgcggacccgcgtgggcaccaagcacgccatcctcctggtggccgtcagcttcgtgacgctgatcaccgggaacatgtccttccgggacctcggccgcgtgatggtcatggtgggggcgaccatgaccgacgacatcggcatgggcgtgacgtacctggccctgctcgccgccttcaaggtccgccccaccttcgccgcggggctgctgctccggaagctgaccagcaaggagctgatgatggccaccatcggcatcgccctcctgtcccagagcacgatccccgagaccatcctggagctcaccgacgccctggccctggggatgatggtgctcaagatcgtgcgcaacatggagaagtaccagctggcggtcaccatcatggccatctcctgcgtgccgaacgccgtgatcctgcagaacgcctggaaggtcagctgcacgatcctcgccgcggtgtccgtcagccccctgctgctcacctccagccagcagaaggccgactggatccccctggccctgaccatcaagggcctcaaccccaccgccatcttcctgacgaccctgtcccggaccagcaagaagcgctcctggccgctcaacgaggcggtgatggccgtgggcatggtcagcatcctggcctccagcctgctcaagaacgacatccccatgaccgggcccctggtggccggcgggctgctcacggtgtgctacgtcctgaccggccggagcgccgacctggagctcgagcgcgcggccgacgtgaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtcttcccggtgtccatccccatcaccgccgccgcgtggtacctctgggaggtgaagaagcagcgcgccggcgtcctgtgggacgtgcccagcccgccgcccgtggggaaggccgagctggaggacggcgcctaccggatcaagcagcgcgggatcttcggctactcccagatcggcgccggggtctacaaggagggcaccttccacaccatgtggcacgtgacgcgcggggcggtgctcatgcaccgcggcaagcggatcgagcccagctgggccgacgtcaagaaggacctgatctcctacgggggcggctggaagctggagggggagtggaaggagggcgaggaggtccaggtgctcgccctggagcccgggaagaacccccgcgccgtccagaccaagcccggcctgttcaagaccaacaccgggacgatcggcgccgtgagcctcgacttctcccccggcaccagcgggtcccccatcgtggaccggaagggcaaggtcgtggggctgtacggcaacggcgtggtcacccgcagcggggcgtacgtgtccgccatcgcccagaccgagaagtccatcgaggacaaccccgagatcgaggacgacatcttccggaagaagcgcctgacgatcatggacctccaccccggcgccgggaagaccaagcggtacctgcccgcgatcgtgcgcgaggccatcaagcggggcctgcgcaccctgatcctcgccccgacccgcgtcgtggccgccgagatggaggaggcgctgcgggggctgcccatccgctaccagacgcccgccatccgggccgagcacaccggccgcgagatcgtggacctcatgtgccacgccaccttcaccatgcggctgctgagccccgtccgcgtgccgaactacaacctcatcatcatggacgaggcccacttcacggaccccgcgtccatcgccgcccggggctacatcagcacccgcgtggagatgggggaggccgccggcatcttcatgaccgcgacgccgcccgggtcccgggacccgttcccccagagcaacgcccccatcatggacgaggagcgcgagatccccgagcggtcctggaacagcggccacgagtgggtcacggacttcaaggggaagaccgtgtggttcgtgccgtccatcaaggccggcaacgacatcgccgcgtgcctgcgcaagaacggcaagaaggtcatccagctgagccggaagaccttcgactccgagtacgtgaagacccgcgccaacgactgggacttcgtggtcacgaccgacatcagcgagatgggggccaacttccgggccgagcgcgtgatcgacccccggcgctgcatgaagcccgtgatcctcaccgacggcgaggagcgggtcatcctggccgggcccatgccggtgacccactccagcgcggcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgccatcgacggggagtaccgcctgcggggcgaggcgcgcaagaccttcgtcgacctcatgcggcgcggggacctgcccgtgtggctggcctaccgggtggccgccgagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcgcgcatctacagcgaccccctcgccctgaaggagttcaaggagttcgccgccggccggaagtccctgaccctcaacctgatcacggagatggggcgcctgcccaccttcatgacccagaaggcgcgggacgccctcgacaacctggccgtcctgcacaccgccgaggtgggcgggcgcgcctacaaccacgcgctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgccgcgtccatcatcctggagttcttcctcatcgtcctgctgatccccgagcccgagaagcagcggacgccccaggacaaccagctcacctacgtggtgatcgccatcctgacggtcgtggccgccaccatggccaacgagatggggttcctggagaagaccaagaaggacctcggcctgggcagcatcaccacgcaggagagcgagtccaacatcctggacatcgacctccgcccggcgagcgcctggaccctgtacgccgtggccaccaccttcgtcacgcccatgctgcggcactccatcgagaacagctccgtgaacgtgagcctcaccgccatcgcgaaccaggccaccgtcctgatggggctgggccgcgggtggcccctctccaagatggacatcggcgtgcccctgctggccatcgggtgctacagccaggtgaacccgatcaccctcacggccgcgctgctgctcctggtcgcccactacgccatcatcggccccggcctgcaggccaaggccacccgcgaggcgcagaagcggaccgccgccgggatcatgaagaaccccaccgtggacggcatcacggtgatcgacctcgagcccatcccgtacgaccccaagttcgagaagcagctggggcaggtcatgctgctcgtgctgtgcgtgacccaggtcctgatgatgcgcaccacctgggccctctgcgaggccctgacgctggcgaccggccccatctccaccctctgggaggggaaccccggccggttctggaacaccacgatcgccgtgagcatggccaacatcttccgcggctcctacctggccggggccggcctcctcttcagcatcatgaagaacaccatcaacacccggcgcgggaccggcaacatcggcgagacgctgggggagaagtggaagtcccggctgaacgcgctcggcaagagcgagttccagatctacaagaagtccgggatccaggaggtggaccgcaccctggccaaggagggcatcaagcgcggggagaccgaccaccacgccgtcagccgcggctccgccaagctgcggtggttcgtggagcgcaacatggtgaccccggagggcaaggtcgtggacctcgggtgcggccgcggcgggtggagctactactgcggcgggctgaagaacgtgcgcgaggtcaaggggctgacgaagggcgggcccgggcacgaggagcccatccccatgtccacctacggctggaacctcgtgcggctgcagagcggggtggacgtcttcttcaccccgcccgagaagtgcgacaccctgctctgcgacatcggcgagagctcccccaaccccacgatcgaggcgggccgcaccctgcgggtgctgaacctcgtggagaactggctgaacaacaacacccagttctgcgtcaaggtgctgaacccgtacatgcccagcgtgatcgagaagatggagaccctccagcgcaagtacgggggcgccctggtccggaaccccctgtcccgcaacagcacccacgagatgtactgggtgtccaacgccacggggaacatcgtgagctccgtcaacatgatcagccgcatgctgatcaaccggttcaccatgaagcacaagaaggccacctacgagccggacgtggacctcggctccgggacccgcaacatcggcatcgagaacgagatccccaacctggacatcatcggcaagcggatcgagaagatcaagcaggagcacgagacgagctggcactacgaccaggaccacccctacaagacctgggcctaccacgggtcctacgagaccaagcagaccggcagcgcgtccagcatggtgaacggggtcgtgaagctgctcacgaagccctgggacgtggtcccgatggtgacccagatggccatgaccgacaccacgcccttcggccagcagcgcgtgttcaaggagaaggtcgacacccggacccaggagcccaaggagggcaccaagaagctgatgcgcatcacggccgagtggctgtggaaggagctcgggaagaagaagacgccccggatgtgcacccgcgaggagttcacccggaaggtgcgctccaacgccgccctgggcgcgatcttcacggacgagaacaagtggaagtccgcccgggaggccgtcgaggactcccgcttctgggagctggtggaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtcgagggggagggcctgcacaagctcggctacatcctgcgggacgtgtccaagaaggagggcggggccatgtacgccgacgacaccgcggggtgggacacccgcatcacgctggaggacctcaagaacgaggagatggtgaccaaccacatgaagggcgagcacaagaagctggccgaggccatcttcaagctgacctaccagaacaaggtcgtgcgggtgcagcgcccgacgccccgggggacggtcatggacatcatcagccggaaggaccagcgcggctccggccaggtggggacctacggcctcaacaccttcaccaacatggaggcccagctgatccggcagatggagggggagggcatcttcaagagcatccagcgcctgacggtgaccgaggagatcgccgtccagaactggctcgcgcgggtgggccgcgagcggctgtcccgcatggccatcagcggggacgactgcgtggtcaagcccctggacgaccggttcgcctccgccctcaccgccctgaacgacatgggcaaggtgcgcaaggacatccagcagtgggagcccagccgggggtggaacgactggacccaggtgccgttctgctcccaccacttccacgagctggtcatgaaggacggccgcgtgctcgtggtcccctgccggaaccaggacgagctgatcgggcgcgcgcggatcagccagggcgccggctggtccctgaaggagacggcctgcctcggcaagagctacgcccagatgtggaccctgatgtacttccaccgccgggacctgcgcctcgccgcgaacgccatctgctccgccgtgcccagccactgggtgcccacctcccggaccacctggagcatccacgccaagcacgagtggatgacgaccgaggacatgctggccgtctggaaccgcgtgtggatccaggagaacccgtggatggaggacaagacccccgtggagtcctgggaggaggtcccctacctgggcaagcgcgaggaccagtggtgcgggagcctcatcggcctgaccagccgggcgacgtgggccaagaacatccagaccgccatcaaccaggtgcgctccctgatcgggaacgaggagtacaccgactacatgcccagcatgaagcggttccgcaaggaggaggaggaggccggcgtgctctggtga

SEQ ID NO: 9412 - RNA, 9876 nt, synthetic construct
  misc_feature 1..9876: note = derived and/or modified CDS sequence (opt1) from DENV-2__EU596489__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccaccatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcacgaccatggccaagaacaagcccaccctggacttcgagctgatcaagaccgaggccaagcagcccgccacgctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacacgatcgtgatcacgccccacagcggggaggagcacgccgtcggcaacgacaccgggaagcacggcaaggagatcaagatcaccccgcagtccagcatcaccgaggccgagctcacggggtacggcaccgtgaccatggagtgcagcccccggaccggcctggacttcaacgagatggtgctgctccagatggaggacaaggcctggctggtccaccggcagtggttcctggacctccccctgccctggctgccgggggccgacacgcagggcagcaactggatccagaaggagaccctcgtgaccttcaagaacccccacgcgaagaagcaggacgtggtcgtgctggggtcccaggagggcgccatgcacaccgccctgacgggggccaccgagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagacgaccatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggacgatgaagatcctgatcggcgtgatcatcacctggatcgggatgaacagccgctccaccagcctgtccgtcagcctcgtgctggtgggcatcgtcaccctgtacctcggggtgatggtgcaggccgacacgggctgcgtcgtgtcctggaagaacaaggagctgaagtgcggcagcgggatcttcatcaccgacaacgtgcacacctggaccgagcagtacaagttccagcccgagttcccctccaagctggcgagcgccatcaagaaggcccacgaggagggcatctgcgggatccggagcgtcacgcgcctcgagaacctgatgtggaagcagatcacccccgagctgaaccacatcctctccgagaacgaggtgaagctgaccatcatgaccggcgacatcaaggggatcatgcaggccggcaagcggagcctgcgcccgcagcccacggagctcaagtactcctggaagacctggggcaaggccaagatgctgagcaccgagtcccacaaccagaccttcctgatcgacgggcccgagacggcggagtgcccgaacaccaaccgggcctggaacagcctcgaggtggaggactacggcttcggggtcttctccaccaacatctggctgaagctgcgcgagaagcaggacgtgttctgcgacagcaagctcatgtccgccgccatcaaggacaaccgggccgtgcacgcggacatgggctactggatcgagagcgccctgaacgacacctggaagatggagaaggcctccttcatcgagatcaagagctgccactggcccaagtcccacaccctgtggagcaacggcgtcctcgagtccgagatgatcatccccaagaacttcgccgggcccgtgagccagcacaactaccgcccgggctaccacacgcagaccgccgggccctggcacctgggcaagctggagatggacttcgacttctgcgaggggaccaccgtggtcgtgacggaggactgcggcaaccggggcccctccctccgcaccaccaccgcgagcgggaagctgatcacggagtggtgctgccggagctgcaccctgcccccgctccgctaccggggcgaggacgggtgctggtacggcatggagatccgccccctgaaggagaaggaggagaacctggtgaactccctcgtcaccgccgggcacggccagatcgacaacttcagcctgggcgtgctggggatggccctcttcctggaggagatgctgcggacccgcgtgggcacgaagcacgccatcctcctggtcgcggtgtccttcgtgaccctgatcaccgggaacatgagcttccgggacctcggccgcgtcatggtgatggtgggggccaccatgacggacgacatcggcatgggcgtcacctacctggccctgctcgccgccttcaaggtgcgccccaccttcgcggccgggctgctgctccggaagctgacctccaaggagctgatgatggccacgatcggcatcgccctcctgagccagtccaccatccccgagaccatcctggagctcaccgacgccctggcgctggggatgatggtgctcaagatcgtccgcaacatggagaagtaccagctggccgtgacgatcatggccatcagctgcgtgccgaacgccgtcatcctgcagaacgcctggaaggtgtcctgcaccatcctcgcggccgtgagcgtcagccccctgctgctcaccagctcccagcagaaggccgactggatccccctggccctgaccatcaagggcctcaaccccacggcgatcttcctgaccaccctgagccggacctccaagaagcgcagctggccgctcaacgaggccgtgatggccgtcggcatggtgtccatcctggccagctccctgctcaagaacgacatccccatgacggggcccctggtggccggcgggctgctcaccgtctgctacgtgctgaccggccggagcgcggacctggagctcgagaaggccgccgacgtgaagtgggaggaccaggccgagatcagcgggtccagccccatcctgtccatcaccatcagcgaggacggctccatgagcatcaagaacgaggaggaggagcacacgctgaccatcctcatccgcaccggcctgctggtcatctccggggtgttcccggtgagcatccccatcaccgccgcggcctggtacctctgggaggtcaagaagcagcgggccggcgtgctgtgggacgtgcccagcccgccgcccgtcgggaaggccgagctggaggacggcgcctaccgcatcaagcagcgggggatcttcggctacagccagatcggcgcgggggtgtacaaggagggcaccttccacacgatgtggcacgtgacccgcggggccgtcctcatgcaccggggcaagcgcatcgagccctcctgggccgacgtgaagaaggacctgatcagctacgggggcggctggaagctggagggggagtggaaggagggcgaggaggtgcaggtcctcgccctggagcccgggaagaacccccgggccgtgcagaccaagcccggcctgttcaagaccaacacggggaccatcggcgcggtgtccctcgacttcagccccggcacctccgggagccccatcgtcgaccgcaagggcaaggtggtggggctgtacggcaacggcgtcgtgacccggtccggggcctacgtgagcgccatcgcccagacggagaagtccatcgaggacaaccccgagatcgaggacgacatcttccgcaagaagcggctgaccatcatggacctccaccccggcgcggggaagaccaagcgctacctgcccgccatcgtccgggaggccatcaagcgcggcctgcggaccctgatcctcgccccgacgcgcgtggtggccgcggagatggaggaggccctgcgcgggctgcccatccggtaccagacccccgccatccgcgccgagcacaccggccgggagatcgtcgacctcatgtgccacgccaccttcacgatgcgcctgctgagccccgtgcgggtgccgaactacaacctcatcatcatggacgaggcgcacttcaccgaccccgccagcatcgccgcccgcggctacatctccacccgggtcgagatgggggaggccgcgggcatcttcatgaccgccacgccgcccgggagccgcgacccgttcccccagtccaacgcccccatcatggacgaggagcgggagatccccgagcgcagctggaactccggccacgagtgggtgaccgacttcaaggggaagaccgtgtggttcgtcccgagcatcaaggccggcaacgacatcgcggcctgcctgcggaagaacggcaagaaggtgatccagctgtcccgcaagaccttcgacagcgagtacgtgaagacgcgggccaacgactgggacttcgtcgtgaccaccgacatctccgagatgggggccaacttccgcgccgagcgggtgatcgacccccgccggtgcatgaagcccgtcatcctcaccgacggcgaggagcgcgtgatcctggcggggcccatgccggtgacgcacagctccgccgcccagcggcgcggccgcatcgggcggaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgcgagaaggtcgacgcgatcgacggggagtaccggctgcgcggcgaggcccggaagaccttcgtggacctcatgcgccgcggggacctgcccgtgtggctggcctaccgcgtcgccgccgagggcatcaactacgcggaccggcgctggtgcttcgacgggatcaagaacaaccagatcctcgaggagaacgtggaggtggagatctggaccaaggagggcgagcggaagaagctgaagccgcgctggctggacgcccggatctactccgaccccctcgccctgaaggagttcaaggagttcgccgcgggccgcaagagcctgacgctcaacctgatcaccgagatggggcggctgcccaccttcatgacccagaaggcccgcgacgccctcgacaacctggccgtcctgcacacggccgaggtgggcgggcgggcgtacaaccacgccctctccgagctgcccgagaccctggagaccctcctgctgctcaccctgctggccacggtcaccggcggcatcttcctcttcctgatgagcgggaagggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacgtacgtggtcatcgccatcctgaccgtggtggccgccaccatggcgaacgagatggggttcctggagaagaccaagaaggacctcggcctgggctccatcacgacccaggagagcgagagcaacatcctggacatcgacctccggccggcctccgcctggaccctgtacgccgtcgccaccacgttcgtgacccccatgctgcgccacagcatcgagaactccagcgtgaacgtctccctcaccgcgatcgccaaccaggccaccgtgctgatggggctgggccgggggtggcccctcagcaagatggacatcggcgtgcccctgctggccatcgggtgctactcccaggtcaacccgatcacgctcaccgcggccctgctgctcctggtggcccactacgccatcatcggccccggcctgcaggccaaggcgacccgcgaggcccagaagcgcaccgccgccgggatcatgaagaaccccacggtggacggcatcaccgtcatcgacctcgagcccatcccgtacgaccccaagttcgagaagcagctgggccaggtgatgctgctcgtgctgtgcgtcacccaggtgctgatgatgcggaccacgtgggccctctgcgaggcgctgaccctggccaccggccccatcagcaccctctgggaggggaaccccggccgcttctggaacacgaccatcgccgtgtccatggccaacatcttccggggcagctacctggccggggcgggcctcctcttctccatcatgaagaacaccaccaacacgcgccgggggaccggcaacatcggcgagaccctgggggagaagtggaagtcccgcctgaacgccctcggcaagtccgagttccagatctacaagaagtccgggatccaggaggtcgaccggaccctggccaaggagggcatcaagcgcggggagacggaccaccacgccgtgtcccggggcagcgcgaagctgcgctggttcgtggagcggaacatggtcaccccggagggcaaggtggtggacctcgggtgcggccgcgggggctggtcctactactgcgggggcctgaagaacgtccgggaggtgaagggcctgaccaagggcgggcccgggcacgaggagcccatccccatgagcacctacggctggaacctcgtgcgcctgcagtccggggtcgacgtgttcttcacgccgcccgagaagtgcgacaccctgctctgcgacatcggcgagagcagccccaaccccaccatcgaggccggccggaccctgcgcgtgctgaacctcgtcgagaactggctgaacaacaacacccagttctgcgtgaaggtgctgaacccgtacatgccctccgtcatcgagaagatggagacgctccagcggaagtacgggggcgccctggtgcgcaaccccctgagccggaactccacccacgagatgtactgggtgagcaacgccaccgggaacatcgtctccagcgtgaacatgatctcccgcatgctgatcaaccgcttcaccatgaagcacaagaaggccacgtacgagccggacgtggacctcggcagcgggacccggaacatcggcatcgagaacgagatccccaacctggacatcatcggcaagcgcatcgagaagatcaagcaggagcacgagacctcctggcactacgaccaggaccacccctacaagacctgggcgtaccacgggagctacgagacgaagcagaccggctccgccagctccatggtcaacggggtggtgaagctgctcaccaagccctgggacgtcgtgccgatggtgacccagatggccatgacggacaccacccccttcggccagcagcgggtcttcaaggagaaggtggacacccgcacgcaggagcccaaggagggcaccaagaagctgatgcggatcaccgccgagtggctgtggaaggagctcgggaagaagaagacgccccgcatgtgcacgcgggaggagttcacccgcaaggtgcggagcaacgccgcgctgggcgccatcttcaccgacgagaacaagtggaagtccgcccgcgaggccgtcgaggacagccggttctgggagctggtggaccgcgagcggaacctccacctggaggggaagtgcgagacctgcgtctacaacatgatgggcaagcgcgagaagaagctgggggagttcggcaaggccaagggctcccgggcgatctggtacatgtggctcggggcccgcttcctggagttcgaggccctgggcttcctcaacgaggaccactggttcagccgggggaactccctgagcggcgtggagggggagggcctgcacaagctcggctacatcctgcgcgacgtgagcaagaaggagggcggggccatgtacgcggacgacacggccgggtgggacacccggatcaccctggaggacctcaagaacgaggagatggtcaccaaccacatgaagggcgagcacaagaagctggccgaggccatcttcaagctgacgtaccagaacaaggtggtgcgcgtccagcggccgacgccccgcgggaccgtgatggacatcatctcccgcaaggaccagcggggcagcggccaggtggggacctacggcctcaacacgttcaccaacatggaggcccagctgatccgccagatggagggggagggcatcttcaagtccatccagcggctgaccgtcaccgaggagatcgcggtgcagaactggctcgcccgcgtgggccgggagcgcctgagccggatggccatctccggggacgactgcgtcgtgaagcccctggacgaccgcttcgccagcgccctcacggcgctgaacgacatgggcaaggtgcggaaggacatccagcagtgggagccctcccgcgggtggaacgactggacccaggtcccgttctgcagccaccacttccacgagctggtgatgaaggacggccggatgctcgtggtcccctgccgcaaccaggacgagctgatcgggcgggcccgcatctcccagggcgccggctggagcctgaaggagaccgcctgcctcgggaagtcctacgcccagatgtggaccctgatgtacttccaccggcgcgacctgcggctcgcggccaacgccatctgcagcgccgtgccctcccactgggtgcccaccagccgcacgacctggtccatccacgccaagcacgagtggatgaccaccgaggacatgctggcggtctggaaccgggtgtggatccaggagaacccgtggatggaggacaagacgcccgtggagagctgggaggaggtcccctacctgggcaagcgcgaggaccagtggtgcgggtccctcatcggcctgaccagccgcgccacctgggccaagaacatccagaccgccatcaaccaggtgcggagcctgatcgggaacgaggagtacacggactacatgccctccatgaagcgcttccggaaggaggaggaggaggcgggcgtgctctggtga

SEQ ID NO: 9413 - RNA, 9876 nt, synthetic construct
  misc_feature 1..9876: note = derived and/or modified CDS sequence (opt1) from DENV-2__EU596490__SS-prME
  source 1..9876: mol_type = other RNA
accgccggggtgatcatcatgctgatccccaccgtcatggccttccacctcaccacccggaacggggagccccacatgatcgtgggccggcaggagaaggggaagtccctgctgttcaagaccgaggacggcgtgaacatgtgcaccctcatggcgatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagcagcgagggggcctggaagcacgtgcagcggatcgagacctggatcctgcgccacccgggcttcaccatcatggccgccatcctggcgtacaccatcgggaccacgcacttccagcgggccctcatcttcatcctgctgaccgccgtggcccccagcatgaccatgcgctgcatcggcatctccaaccgggacttcgtcgagggcgtgagcgggggctcctgggtggacatcgtcctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgccatgttcacgtgcaagaagaacatggagggcaaggtggtgctgcccgagaacctggagtacaccatcgtcatcacgccccacagcggggaggagcacgcggtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgccaagaagcaggacgtcgtggtcctggggtcccaggagggcgcgatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggccgagccgcccttcggcgactcctacatcatcatcggggtggagccgggccagctcaagctgaactggttcaagaaggggagctccatcggccagatgttcgagaccacgatgcgcggcgcgaagcggatggccatcctgggggacaccgcctgggacttcggcagcctcgggggcgtcttcacctccatcgggaaggccctgcaccaggtgttcggcgccatctacggcgcggccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgacaccggctgcgtggtctcctggaagaacaaggagctgaagtgcggcagcgggatcttcatcacggacaacgtgcacacctggaccgagcagtacaagttccagcccgagtcccccagcaagctggccagcgcgatccagaaggcccacgaggagggcatctgcgggatccggtccgtgacccgcctcgagaacctgatgtggaagcagatcacgcccgagctgaaccacatcctcagcgagaacgaggtcaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgccgagtgcccgaacacgaaccgggcgtggaactccctcgaggtggaggactacggcttcggggtgttcagcaccaacatctggctgaagctgcgcgagaagcaggacgtcttctgcgactccaagctcatgagcgccgccatcaaggacaaccgggccgtgcacgccgacatgggctactggatcgagtccgcgctgaacgacacctggaagatggagaaggccagcttcatcgagatcaagtcctgccactggcccaagagccacaccctgtggtccaacggcgtgctcgagagcgagatgatcatccccaagaacttcgccgggcccgtctcccagcacaactaccgcccgggctaccacacccagacggccgggccctggcacctgggcaagctggagatggacttcgacttctgcgaggggaccaccgtggtggtcaccgaggactgcggcaaccggggccccagcctccgcacgaccaccgccagcgggaagctgatcaccgagtggtgctgccggtcctgcacgctgcccccgctccgctaccggggcgaggacgggtgctggtacggcatggagatccgccccctgaaggagaaggaggagaacctggtgaacagcctcgtgaccgcggggcacggccagatcgacaacttctccctgggcgtcctggggatggccctcttcctggaggagatgctgcggacccgcgtgggcaccaagcacgccatcctcctggtggccgtcagcttcgtgacgctgatcaccgggaacatgtccttccgggacctcggccgcgtgatggtcatggtgggggcgaccatgaccgacgacatcggcatgggcgtgacgtacctggccctgctcgccgccttcaaggtccgccccaccttcgccgcggggctgctgctccggaagctgaccagcaaggagctgatgatggccaccatcggcatcgccctcctgtcccagagcacgatccccgagaccatcctggagctcaccgacgccctggccctggggatgatggtgctcaagatcgtgcgcaacatggagaagtaccagctggcggtcaccatcatggccatctcctgcgtgccgaacgccgtgatcctgcagaacgcctggaaggtcagctgcacgatcctcgccgcggtgtccgtcagccccctgctgctcacctccagccagcagaaggccgactggatccccctggccctgaccatcaagggcctcaaccccaccgccatcttcctgacgaccctgtcccggaccagcaagaagcgctcctggccgctcaacgaggcggtgatggccgtgggcatggtcagcatcctggcctccagcctgctcaagaacgacatccccatgaccgggcccctggtggccggcgggctgctcacggtgtgctacgtcctgaccggccggagcgccgacctggagctcgagcgcgcggccgacgtgaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtcttcccggtgtccatccccatcaccgccgccgcgtggtacctctgggaggtgaagaagcagcgcgccggcgtcctgtgggacgtgcccagcccgccgcccgtggggaaggccgagctggaggacggcgcctaccggatcaagcagcgcgggatcttcggctactcccagatcggcgccggggtctacaaggagggcaccttccacaccatgtggcacgtgacgcgcggggcggtgctcatgcaccgcggcaagcggatcgagcccagctgggccgacgtcaagaaggacctgatctcctacgggggcggctggaagctggagggggagtggaaggagggcgaggaggtccaggtgctcgccctggagcccgggaagaacccccgcgccgtccagaccaagcccggcctgttcaagaccaacaccgggacgatcggcgccgtgagcctcgacttctcccccggcaccagcgggtcccccatcgtggaccggaagggcaaggtcgtggggctgtacggcaacggcgtggtcacccgcagcggggcgtacgtgtccgccatcgcccagaccgagaagtccatcgaggacaaccccgagatcgaggacgacatcttccggaagaagcgcctgacgatcatggacctccaccccggcgccgggaagaccaagcggtacctgcccgcgatcgtgcgcgaggccatcaagcggggcctgcgcaccctgatcctcgccccgacccgcgtcgtggccgccgagatggaggaggcgctgcgggggctgcccatccgctaccagacgcccgccatccgggccgagcacaccggccgcgagatcgtggacctcatgtgccacgccaccttcaccatgcggctgctgagccccgtccgcgtgccgaactacaacctcatcatcatggacgaggcccacttcacggaccccgcgtccatcgccgcccggggctacatcagcacccgcgtggagatgggggaggccgccggcatcttcatgaccgcgacgccgcccgggtcccgggacccgttcccccagagcaacgcccccatcatggacgaggagcgcgagatccccgagcggtcctggaacagcggccacgagtgggtcacggacttcaaggggaagaccgtgtggttcgtgccgtccatcaaggccggcaacgacatcgccgcgtgcctgcgcaagaacggcaagaaggtcatccagctgagccggaagaccttcgactccgagtacgtgaagacccgcgccaacgactgggacttcgtggtcacgaccgacatcagcgagatgggggccaacttccgggccgagcgcgtgatcgacccccggcgctgcatgaagcccgtgatcctcaccgacggcgaggagcgggtcatcctggccgggcccatgccggtgacccactccagcgcggcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgccatcgacggggagtaccgcctgcggggcgaggcgcgcaagaccttcgtcgacctcatgcggcgcggggacctgcccgtgtggctggcctaccgggtggccgccgagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcgcgcatctacagcgaccccctcgccctgaaggagttcaaggagttcgccgccggccggaagtccctgaccctcaacctgatcacggagatggggcgcctgcccaccttcatgacccagaaggcgcgggacgccctcgacaacctggccgtcctgcacaccgccgaggtgggcgggcgcgcctacaaccacgcgctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgccgcgtccatcatcctggagttcttcctcatcgtcctgctgatccccgagcccgagaagcagcggacgccccaggacaaccagctcacctacgtggtgatcgccatcctgacggtcgtggccgccaccatggccaacgagatggggttcctggagaagaccaagaaggacctcggcctgggcagcatcaccacgcaggagagcgagtccaacatcctggacatcgacctccgcccggcgagcgcctggaccctgtacgccgtggccaccaccttcgtcacgcccatgctgcggcactccatcgagaacagctccgtgaacgtgagcctcaccgccatcgcgaaccaggccaccgtcctgatggggctgggccgcgggtggcccctctccaagatggacgtgggcgtgcccctgctggccatcgggtgctacagccaggtcaacccgatcaccctcacggccgcgctgctgctcctggtggcccactacgccatcatcggccccggcctgcaggccaaggccacccgcgaggcgcagaagcggaccgccgccgggatcatgaagaaccccaccgtggacggcatcacggtcatcgacctcgagcccatcccgtacgaccccaagttcgagaagcagctgggccaggtgatgctgctcgtgctgtgcgtcacccaggtgctgatgatgcgcaccacctgggccctctgcgaggccctgacgctggcgaccggccccatctccaccctctgggaggggaaccccggccggttctggaacaccacgatcgccgtgagcatggccaacatcttccgcggctcctacctggccggggccggcctcctcttcagcatcatgaagaacaccaccaacacccggcgcgggacgggcaacatcggcgagaccctgggggagaagtggaagtcccggctgaacgcgctcggcaagagcgagttccagatctacaagaagtccgggatccaggaggtcgaccgcaccctggccaaggagggcatcaagcgcggggagaccgaccaccacgccgtgagccgcggctccgccaagctgcggtggttcgtggagcgcaacatggtcacgccggagggcaaggtggtggacctcgggtgcggccgcggcgggtggagctactactgcggcgggctgaagaacgtccgcgaggtgaaggggctgaccaagggcgggcccgggcacgaggagcccatccccatgtccacctacggctggaacctcgtgcggctgcagagcggggtcgacgtgttcttcaccccgcccgagaagtgcgacacgctgctctgcgacatcggcgagagctcccccaaccccaccatcgaggcgggccgcaccctgcgggtgctgaacctcgtcgagaactggctgaacaacaacacccagttctgcgtgaaggtgctgaacccgtacatgcccagcgtcatcgagaagatggagaccctccagcgcaagtacgggggcgccctggtgcggaaccccctgtcccgcaacagcacgcacgagatgtactgggtgtccaacgccaccgggaacatcgtcagctccgtgaacatgatcagccgcatgctgatcaaccggttcaccatgaagcacaagaaggccacctacgagccggacgtggacctcggctccgggacgcgcaacatcggcatcgagaacgagatccccaacctggacatcatcggcaagcggatcgagaagatcaagcaggagcacgagaccagctggcactacgaccaggaccacccctacaagacctgggcctaccacgggtcctacgagaccaagcagacgggcagcgcgtccagcatggtcaacggggtggtgaagctgctcaccaagccctgggacgtcgtgccgatggtgacccagatggccatgaccgacacgacccccttcggccagcagcgcgtcttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtccgctccaacgccgccctgggcgcgatcttcaccgacgagaacaagtggaagtccgcccgggaggccgtggaggactcccgcttctgggagctggtggaccgggagcgcaacctccacctggaggggaagtgcgagacctgcgtctacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcacaagctcggctacatcctgcgggacgtgtccaagaaggagggcggggccatgtacgccgacgacaccgcggggtgggacacgcgcatcaccctggaggacctcaagaacgaggagatggtcaccaaccacatgaagggcgagcacaagaagctggccgaggccatcttcaagctgacctaccagaacaaggtggtgcgggtccagcgcccgacgccccgcgggaccgtgatggacatcatcagccggaaggaccagcgcggctccggccaggtggggacctacggcctcaacaccttcacgaacatggaggcccagctgatccggcagatggagggggagggcatcttcaagagcatccagcgcctgaccgtcaccgaggagatcgccgtgcagaactggctcgcgcgggtgggccgcgagcggctgtcccgcatggccatcagcggggacgactgcgtcgtgaagcccctggacgaccggttcgcctccgccctcaccgccctgaacgacatgggcaaggtgcgcaaggacatccagcagtgggagcccagccgggggtggaacgactggacgcaggtcccgttctgctcccaccacttccacgagctggtgatgaaggacggccgcgtgctcgtcgtgccctgccggaaccaggacgagctgatcgggcgcgcgcggatcagccagggcgccggctggtccctgaaggagaccgcctgcctcggcaagagctacgcccagatgtggaccctgatgtacttccaccgccgggacctgcgcctcgccgcgaacgccatctgctccgccgtgcccagccactgggtccccacctcccggaccacgtggagcatccacgccaagcacgagtggatgaccaccgaggacatgctggccgtgtggaaccgcgtgtggatccaggagaacccgtggatggaggacaagacccccgtcgagtcctgggaggaggtgccctacctgggcaagcgcgaggaccagtggtgcgggagcctcatcggcctgacgagccgggcgacctgggccaagaacatccagaccgccatcaaccaggtgcgctccctgatcgggaacgaggagtacaccgactacatgcccagcatgaagcggttccgcaaggaggaggaggaggccggcgtcctctggtga

SEQ ID NO: 9414 - RNA, 9876 nt, synthetic construct
  misc_feature 1..9876: note = derived and/or modified CDS sequence (opt1) from DENV-2__EU596491__SS-prME
  source 1..9876: mol_type = other RNA
accgccggcgtcatcatcatgctgatccccaccgtcatggccttccacctcaccacccggaacggggagccccacatgatcgtgggccggcaggagaaggggaagtccctgctgttcaagaccgaggacggcgtgaacatgtgcaccctcatggcgatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgccatcctggcgtacaccatcgggaccacgcacttccagcgggccctcatcttcatcctgctgaccgccgtggcccccagcatgaccatgcgctgcatcggcatctccaaccgggacttcgtcgagggcgtgagcgggggctcctgggtggacatcgtcctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgccatgttcacgtgcaagaagaacatggagggcaagatcgtgcagcccgagaacctggagtacaccatcgtgatcacgccccacagcggggaggagcacgcggtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgccaagaagcaggacgtggtcgtgctcgggtcccaggagggcgcgatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacgcccccgtcaacatcgaggcggagccgcccttcggcgacagctacatcatcgtgggggtggagccgggccagctgaagctcaactggttcaagaaggggtccagcatcggccagatgttcgagaccaccatgcgcggcgccaagcggatggccatcctgggggacaccgcctgggacttcggctccctcggcggggtcttcacgagcatcgggaaggccctccaccaggtgttcggggcgatctacggcgccgccttctccggggtgagctggaccatgaagatcctgatcggcgtcatcatcacctggatcgggatgaactcccgcagcacctccctgagcgtgtccctggtgctcgtcggcgtggtgacgctgtacctgggggccgtcgtgcaggcggacagcggctgcgtggtctcctggaagaacaaggagctcaagtgcggcagcgggatcttcatcaccgacaacgtgcacacctggaccgagcagtacaagttccagcccgagtcccccagcaagctggccagcgccatccagaaggcccacgaggagggcatctgcgggatccggtccgtgacgcgcctggagaacctcatgtggaagcagatcacccccgagctgaaccacatcctgagcgagaacgaggtcaagctcaccatcatgaccggcgacatcaaggggatcatgcaggccggcaagcggtccctgcgcccgcagcccacggagctgaagtacagctggaagacctggggcaaggcgaagatgctctccaccgagagccacaaccagaccttcctgatcgacgggcccgagacggccgagtgcccgaacaccaaccgggcctggaactccctggaggtggaggactacggcttcggggtgttcaccaccaacatctggctcaagctgcgcgagaagcaggacgtcttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacacgctgtggagcaacggcgtgctggagtccgagatgatcatccccaagaacttcgccgggcccgtgagccagcacaactaccgcccgggctaccacacccagaccgcggggccctggcacctcggcaagctggagatggacttcgacttctgcgaggggaccacggtggtcgtgaccgaggactgcggcaaccggggcccctccctgcgcaccaccacggccagcgggaagctcatcaccgagtggtgctgccggagctgcaccctgcccccgctgcgctaccggggcgaggacgggtgctggtacggcatggagatccgccccctcaaggagaaggaggagaacctggtgaactccctggtcaccgccgggcacggccagatcgacaacttcagcctcggcgtgctggggatggccctgttcctcgaggagatgctgcggacgcgcgtgggcaccaagcacgcgaccctgctcgtcgccctgtccttcgtgaccctgatcacggggaacatgagcttccgggacctcggccgcgtgatggtcatggtgggggccaccatgaccgacgacatcggcatgggcgtgacctacctggccctgctcgccgcgttcaaggtccgccccacgttcgccgccgggctgctgctccggaagctgacctccaaggagctgatgatggccaccatcggcatcgccctcctgagccagtccaccctgcccgagacgatcctcgagctgaccgacgcgctggccctcgggatgatggtgctgaagatcgtgcgcaacatggagaagtaccagctggccgtcaccatcatggccatcagctgcgtgccgaacgccgtgatcctccagaacgcgtggaaggtctcctgcaccatcctggccgccgtgagcgtcagccccctgctcctgacgagctcccagcagaaggccgactggatccccctggcgctcaccatcaagggcctgaaccccaccgccatcttcctgaccacgctcagccggacctccaagaagcgcagctggccgctgaacgaggccatcatggccgtgggcatggtgtccatcctggccagctccctcctgaagaacgacatccccatgaccgggcccctggtcgcgggcgggctcctgaccgtgtgctacgtgctgacgggccggagcgccgacctcgagctggagcgcgccgccgacgtcaagtgggaggaccaggccgagatcagcgggtccagccccatcctgtccatcaccatcagcgaggacggctccatgagcatcaagaacgaggaggaggagcagaccctcaccatcctgatccggaccggcctgctcgtgatctccggggtgttcccggtcagcatccccatcacggcggccgcctggtacctgtgggaggtgaagaagcagcgcgccggcgtgctgtgggacgtccccagcccgccgcccgtggggaaggccgagctcgaggacggcgcgtaccggatcaagcagcgcgggatcctgggctacagccagatcggcgccggggtgtacaaggagggcaccttccacaccatgtggcacgtcacccgcggggccgtgctgatgcaccgcggcaagcggatcgagccctcctgggccgacgtgaagaaggacctcatcagctacgggggcggctggaagctggagggggagtggaaggagggcgaggaggtccaggtgctggccctcgagcccgggaagaacccccgcgcggtgcagacgaagcccggcatcttcaagaccaacaccgggaccatcggcgccgtctccctggacttcagccccggcacgtccgggagccccatcgtggaccggaagggcaaggtggtcgggctgtacggcaacggcgtggtgacccgctccggggcctacgtcagcgccatcgcgcagaccgagaagtccatcgaggacaaccccgagatcgaggacgacatcttccggaagaagcgcctcaccatcatggacctgcaccccggcgccgggaagacgaagcggtacctgcccgccatcgtgcgcgaggccatcaagcggggcctgcgcaccctcatcctggccccgacccgcgtggtcgcggccgagatggaggaggccctgcgggggctccccatccgctaccagacccccgccatccgggccgagcacacgggccgcgagatcgtggacctgatgtgccacgcgaccttcaccatgcggctgctcagccccgtgcgcgtcccgaactacaacctgatcatcatggacgaggcccacttcaccgaccccgccagcatcgccgcccggggctacatctccacgcgcgtggagatgggggaggcggccggcatcttcatgaccgccacgccgcccgggagccgggacccgttcccccagtccaacgcccccatcatcgacgaggagcgcgagatccccgagcggagctggaactccggccacgagtgggtgaccgacttcaaggggaagacggtctggttcgtgccgagcatcaaggcgggcaacgacatcgccgcctgcctgcgcaagaacggcaagaaggtgatccagctctcccggaagaccttcgacagcgagtacgtcaagacccgcgccaacgactgggacttcgtggtgaccacggacatctccgagatgggggccaacttcaaggcggagcgggtcatcgacccccgccggtgcatgaagcccgtgatcctgaccgacggcgaggagcgcgtgatcctggccgggcccatgccggtcacccacagctccgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgcgagaaggtggacgccgtggacggggagtaccggctccgcggcgaggcccggaagacgttcgtcgacctgatgcgccgcggggacctgcccgtgtggctcgcctacaaggtggccgcggagggcatcaactacgccgaccgcaagtggtgcttcgacgggatcaagaacaaccagatcctggaggagaacgtcgaggtggagatctggaccaaggagggcgagcggaagaagctgaagccgcgctggctcgacgcccggatctactccgaccccctggccctgaaggagttcaaggagttcgcggccggccgcaagagcctcaccctgaacctgatcaccgagatggggcggctccccacgttcatgacccagaaggcccgcaacgccctggacaacctggccgtcctccacaccgcggaggtgggcgggcgggcccacaaccacgccctgtccgagctgcccgagaccctcgagacgctgctgctcctgaccctgctcgccaccgtgaccggcggcatcttcctgttcctgatgagcgggaagggcatcgggaagatgaccctcggcatgtgctgcatcatcacggcctccatcctgctgtggtacgcgcagatccagccgcactggatcgccgccagcatcatcctcgagttcttcctgatcgtcctgctcatccccgagcccgagaagcagcgcacgccccaggacaaccagctgacctacgtggtgatcgccatcctgaccgtcgtggccgcgacgatggccaacgagatggggttcctcgagaagaccaagaaggacctgggcttcggctccatcaccacccaggagagcgagagcaacatcctggacatcgacctccggccggcctccgcctggacgctgtacgccgtggcgaccaccttcgtcacccccatgctgcgccacagcatcgagaactccagcgtgaacgtgtccctcacggccatcgccaaccaggccaccgtcctgatggggctgggcaaggggtggcccctcagcaagatggacatcggcgtgcccctgctggcgatcgggtgctactcccaggtgaacccgatcaccctcaccgccgccctgctgctcctggtcgcccactacgccatcatcggccccggcctgcaggcgaaggccacgcgggaggcccagaagcgcgccgccgcggggatcatgaagaaccccaccgtggacggcatcaccgtgatcgacctcgagcccatcccgtacgaccccaagttcgagaagcagctggggcaggtcatgctgctcatcctgtgcgtgacccaggtgctgatgatgcggacgacctgggccctctgcgaggccctgaccctggccaccggccccatcagcacgctctgggaggggaaccccggccgcttctggaacaccaccatcgccgtctccatggcgaacatcttccgcggcagctacctggccggggccggcctcctgttctccatcatgaagaacaccacgaacacccggcgcgggaccggcaacgtgggcgagaccctgggggagaagtggaagtcccggctgaacgccctcggcaagtccgagttccagatctacaagaagtccgggatccaggaggtggaccgcacgctggcgaaggagggcatcaagcgcggggagaccgaccaccacgccgtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcggccccgggcacgaggagcccatccccatgagcacgtacggctggaacctcgtgcggctgcagtccggggtggacgtcttcttcaccccgcccgagaagtgcgacaccctgctctgcgacatcggcgagagcagccccaaccccaccatcgaggccggccgcaccctgcgggtgctgaacctcgtggagaactggctgaacaacaacacgcagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgcgaccgggaacatcgtgtccagcgtgaacatgatctcccggatgctgatcaaccgcttcacgatgaagcacaagaaggccacctacgagccggacgtcgacctcggcagcgggacccggaacatcggcatcgagtccgagatccccaacctggacatcatcggcaagcgcatcgagaagatcaagcaggagcacgagaccagctggcactacgaccaggaccacccctacaagacgtgggcctaccacgggtcctacgagaccaagcagaccggcagcgcctccagcatggtgaacggggtggtccgcctgctcaccaagccctgggacgtggtgccgatggtcacgcagatggccatgaccgacaccacccccttcggccagcagcgggtgttcaaggagaaggtggacacgcgcacccaggagcccaaggagggcaccaagaagctgatgaagatcaccgcggagtggctgtggaaggagctcgggaagaagaagacgccccggatgtgcacccgcgaggagttcacccggaaggtccgctccaacgccgccctgggcgccatcttcaccgacgagaacaagtggaagtccgcccgggaggcggtggaggacgggcgcttctgggagctggtcgaccgggagcgcaacctccacctggagggcaagtgcgagacgtgcgtgtacaacatgatggggaagcgggagaagaagctgggcgagttcggcaaggccaaggggtcccgcgccatctggtacatgtggctcggcgcccggttcctggagttcgaggcgctggggttcctcaacgaggaccactggttcagccgcggcaactccctgagcggggtggagggcgagggcctgcaccggctcgggtacatcctgcgcgaggtcggcaagaaggagggcggcgccatgtacgccgacgacaccgccgggtgggacacccggatcaccctggaggacctcaagaacgaggagatggtgacgaaccacatgaagggcgagcacaagaagctggccgaggcgatcttcaagctgacctaccagaacaaggtggtccgcgtgcagcggccgacgccccggggcaccgtgatggacatcatcagccggaaggaccagcgcgggtccggccaggtcgggacgtacggcctcaacaccttcaccaacatggaggcccagctgatccgccagatggagggcgaggggatcttcaagagcatccagcacctgaccgccacggaggagatcgccgtgcagaactggctcgcccgggtgggccgcgagcggctgtcccgcatggcgatcagcggggacgactgcgtcgtgaagcccatcgacgaccggttcgcctccgccctgaccgccctcaacgacatgggcaaggtgcgcaaggacatccagcagtgggagcccagccgggggtggaacgactggacccaggtcccgttctgctcccaccacttccacgagctggtgatgaaggacggccgcgtgctggtcgtgccctgccggaaccaggacgagctcatcggccgcgcccggatcagccagggggcgggctggtccctgaaggagaccgcctgcctgggcaagagctacgcccagatgtggaccctcatgtacttccaccgccgggacctgcgcctggccgccaacgcgatctgctccgccgtgcccagccactgggtccccacgtcccggaccacctggagcatccacgccaagcacgagtggatgaccacggaggacatgctcgccgtgtggaaccgcgtgtggatccaggagaacccgtggatggaggacaagacccccgtcgagtcctgggaggaggtgccctacctgggcaagcgggaggaccagtggtgcgggagcctgatcggcctcacctcccgcgcgacctgggccaagaacatccagacggccatcaaccaggtgcggagcctgatcggcaacgaggagtacaccgactacatgcccagcatgaagcgcttccgccgggaggaggaggaggccggggtcctgtggtga

SEQ ID NO: 9415 - RNA, 9876 nt, synthetic construct
  misc_feature 1..9876: note = derived and/or modified CDS sequence (opt1) from DENV-2__EU677141__SS-prME
  source 1..9876: mol_type = other RNA
accgccggggtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggtacgtcctggggcgcctgatcaccgtgaacccgatcgtgaccggcaaggacagccccgtcaacatcgaggcggagccgcccttcggggactcctacatcatcatcggcgtggagccggggcagctcaagctgaactggttcaagaagggcagctccatcggccagatgttcgagaccacgatgcgcggggccaagcggatggccatcctgggcgacaccgcctgggacttcgggagcctcggcggggtgttcacctccatcggcaaggccctgcaccaggtcttcggcgcgatctacggggccgccttcagcggcgtgtcctggaccatgaagatcctgatcggggtgatcatcacgtggatcggcatgaacagccgctccaccagcctgtccgtcagcctcgtgctggtgggggtcgtgaccctgtacctcggcgtgatggtccaggccgactccggctgcgtggtgagctggaagaacaaggagctgaagtgcgggtccggcatcttcatcaccgacaacgtccacacgtggaccgagcagtacaagttccagcccgagagccccagcaagctggcgtccgccatccagaaggcccacgaggaggggatctgcggcatccggagcgtgacccgcctcgagaacctgatgtggaagcagatcacccccgagctgaaccacatcctctccgagaacgaggtgaagctgacgatcatgaccggggacatcaagggcatcatgcaggccggcaagcggagcctgcgcccgcagcccaccgagctcaagtactcctggaagacctgggggaaggccaagatgctgagcacggagtcccacaaccagaccttcctgatcgacggccccgagaccgcggagtgcccgaacaccaaccgggcctggaacagcctcgaggtcgaggactacgggttcggcgtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggggtgctcgagtccgagatgatcatccccaagaacttcgccggccccgtgagccagcacaactaccgcccggggtaccacacccagaccgccggcccctggcacctggggaagctggagatggacttcgacttctgcgagggcacgaccgtggtggtcaccgaggactgcggcaaccgggggcccagcctccgcaccacgaccgcgtccggcaagctgatcaccgagtggtgctgccggagctgcaccctgcccccgctccgctaccgcggggaggacggctgctggtacgggatggagatccgccccctgaaggagaaggaggagaacctggtgaactccctcgtgacggccggccacggccagatcgacaacttcagcctgggggtcctgggcatggccctcttcctggaggagatgctgcggacccgcgtggggaccaagcacgccatcctcctggtggcggtctccttcgtgaccctgatcacgggcaacatgagcttccgggacctcgggcgcgtgatggtcatggtgggcgccaccatgaccgacgacatcggcatgggggtgacctacctggccctgctcgccgccttcaaggtccgccccacgttcgcggccggcctgctgctccggaagctgacctccaaggagctgatgatggccaccatcgggatcgccctcctgagccagtccaccatccccgagacgatcctggagctcaccgacgccctggcgctgggcatgatggtgctcaagatcgtgcgcaacatggagaagtaccagctggccgtcaccatcatggccatcctgtgcgtgccgaacgccgtgatcctccagaacgcctggaaggtcagctgcaccatcctggcggccgtgtccgtcagccccctgctcctgacgtccagccagcagaaggccgactggatccccctggccctcaccatcaagggcctgaaccccaccgcgatcttcctgaccacgctctcccggaccagcaagaagcgctcctggccgctgaacgaggccgtgatggccgtggggatggtcagcatcctggcctccagcctcctgaagaacgacatccccatgaccggccccctggtggccgggggcctcctgaccgtgtgctacgtcctgacggggcggagcgcggacctcgagctggagcgcgccgccgacgtgaagtgggaggaccaggccgagatctccggcagctcccccatcctgagcatcaccatctccgaggacggcagcatgtccatcaagaacgaggaggaggagcagaccctcaccatcctgatccggacggggctgctcgtgatcagcggcgtcttcccggtgtccatccccatcaccgccgcggcctggtacctgtgggaggtgaagaagcagcgcgccggggtcctgtgggacgtgcccagcccgccgcccgtgggcaaggccgagctcgaggacggggcctaccggatcaagcagcgcggcatcttcggctactcccagatcggggcgggcgtctacaaggaggggaccttccacaccatgtggcacgtgacccggggcgccgtgctgatgcaccgcgggaagcggatcgagcccagctgggccgacgtcaagaaggacctgatctcctacggcggcgggtggaagctcgagggcgagtggaaggagggggaggaggtccaggtgctggccctggagcccggcaagaacccccgcgccgtccagacgaagcccggcctcttcaagaccaacaccggcaccatcggcgcggtgagcctggacttctcccccgggacgagcggctcccccatcgtggaccggaaggggaaggtcgtgggcctgtacggcaacggggtggtcacccgcagcggcgcctacgtgtccgccatcgcccagaccgagaagtccatcgaggacaaccccgagatcgaggacgacatcttccggaagaagcgcctcaccatcatggacctgcaccccggggcgggcaagacgaagcggtacctgcccgccatcgtgcgcgaggccatcaagcgggggctgcgcaccctcatcctggccccgacccgcgtcgtggccgcggagatggaggaggccctgcggggcctccccatccgctaccagacccccgccatccgggccgagcacacgggccgcgagatcgtggacctgatgtgccacgccaccttcaccatgcggctgctcagccccgtccgcgtgccgaactacaacctgatcatcatggacgaggcgcacttcaccgaccccgcctccatcgccgcccgggggtacatcagcacgcgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtcaccgacttcaagggcaagacggtgtggttcgtgccgtccatcaaggccggcaacgacatcgcggcctgcctgcgcaagaacgggaagaaggtcatccagctcagccggaagaccttcgactccgagtacgtgaagacccgcgccaacgactgggacttcgtggtcaccacggacatcagcgagatgggcgccaacttccgggccgagcgcgtgatcgacccccggcgctgcatgaagcccgtgatcctgaccgacggggaggagcgggtcatcctggcgggccccatgccggtgacccactccagcgccgcccagcgccgcgggcggatcggccgcaaccccaagaacgagaacgaccagtacatctacatgggcgagcccctcgagaacgacgaggactgcgcccactggaaggaggccaagatgctgctggacaacatcaacacccccgaggggatcatcccgtccatgttcgagcccgagcgggagaaggtggacgcgatcgacggcgagtaccgcctccgcggggaggcccgcaagacgttcgtcgacctgatgcggcgcggcgacctgcccgtgtggctcgcctaccgggtggccgccgaggggatcaactacgcggaccgccggtggtgcttcgacggcatcaagaacaaccagatcctggaggagaacgtcgaggtggagatctggaccaaggagggcgagcgcaagaagctgaagccgcggtggctcgacgcccgcatctacagcgaccccctggccctgaaggagttcaaggagttcgccgcggggcggaagtccctcaccctgaacctgatcaccgagatgggccgcctccccacgttcatgacccagaaggcccgggacgccctggacaacctggccgtcctccacaccgccgaggtcggcgggcgcgcgtacaaccacgccctgagcgagctgcccgagaccctcgagacgctgctgctcctgaccctgctcgccaccgtgaccggcgggatcttcctgttcctgatgtccgggaaggggatcggcaagatgacgctcgggatgtgctgcatcatcaccgccagcatcctgctgtggtacgcccagatccagccgcactggatcgcggcctccatcatcctcgagttcttcctgatcgtcctgctcatccccgagcccgagaagcagcggacgccccaggacaaccagctgacctacgtggtgatcgccatcctgaccgtcgtggccgccacgatggcgaacgagatgggcttcctcgagaagaccaagaaggacctgggcctggggagcatcatcacccaggagagcgagtccaacatcctcgacatcgacctgcgcccggccagcgcctggaccctgtacgccgtggccacgaccttcgtcacccccatgctccggcactccatcgagaacagctccgtgaacgtgagcctgaccgcgatcgccaaccaggccacggtcctgatgggcctcgggcgcggctggcccctgtccaagatggacatcggggtgcccctgctcgccatcggctgctacagccaggtgaacccgatcaccctgaccgcggccctgctcctgctggtcgcccactacgccatcatcggccccgggctccaggccaaggcgacccgcgaggcccagaagcgggccgccgccggcatcatgaagaaccccacggtggacgggatcaccgtgatcgacctggagcccatcccgtacgaccccaagttcgagaagcagctgggccaggtcatgctcctggtgctgtgcgtgacccaggtcctcatgatgcgcaccacgtgggcgctgtgcgaggccctgaccctcgccaccgggcccatctccaccctgtgggagggcaaccccggccggttctggaacacgaccatcgccgtgagcatggccaacatcttccgcgggtcctacctggcgggcgccgggctcctgttcagcatcatgaagaacaccaccaacacgcggcgcggcaccggcaacatcggggagaccctgggcgagaagtggaagtcccggctcaacgccctgggcaagagcgagttccagatctacaagaagtccggcatccaggaggtggaccgcaccctggccaaggaggggatcaagcggggcgagacggaccaccacgcggtcagccgcggctccgccaagctccggtggttcgtggagcgcaacatggtgaccccggaggggaaggtcgtggacctgggctgcgggcggggcgggtggagctactactgcggcggcctgaagaacgtgcgcgaggtcaaggggctcaccaagggcgggcccggccacgaggagcccatccccatgtccacctacgggtggaacctggtgcggctgcagagcggcgtggacgtcttcttcacgccgcccgagaagtgcgacaccctcctgtgcgacatcggcgagagctcccccaaccccaccatcgaggccgggcgcaccctgcgggtgctcaacctggtggagaactggctgaacaacaacacgcagttctgcatcaaggtcctcaacccgtacatgcccagcgtgatcgagaagatggagaccctgcagcgcaagtacggcggggccctggtgcggaaccccctgtcccgcaacagcacccacgagatgtactgggtctccaacgccaccggcaacatcgtgagctccgtgaacatgatcagccgcatgctcatcaaccggttcaccatgaagcacaagaaggcgacgtacgagccggacgtcgacctggggtccggcacccgcaacatcggcatcgagaacgagatccccaacctggacatcatcgggaagcggatcgagaagatcaagcaggagcacgagaccagctggcactacgaccaggaccacccctacaagacctgggcctaccacggctcctacgagacgaagcagaccgggagcgcctccagcatggtgaacggcgtggtccgcctcctgaccaagccctgggacgtggtgccgatggtcacccagatggccatgacggacaccacccccttcggccagcagcgggtgttcaaggagaaggtggacacccgcacgcaggagcccaaggaggggaccaagaagctgatgcggatcaccgccgagtggctctggaaggagctgggcaagaagaagacgccccggatgtgcacgcgggaggagttcacccgcaaggtccggtccaacgcggccctgggggccatcttcaccgacgagaacaagtggaagtccgcccgcgaggccgtggaggactcccggttctgggagctcgtcgaccgcgagcggaacctgcacctggagggcaagtgcgagacctgcgtgtacaacatgatggggaagcgcgagaagaagctcggcgagttcggcaaggcgaaggggagccgggccatctggtacatgtggctgggcgcccgcttcctggagttcgaggccctcgggttcctgaacgaggaccactggttctcccggggcaacagcctgagcggggtggagggcgagggcctccacaagctggggtacatcctgcgcgacgtctccaagaaggagggcggggcgatgtacgccgacgacacggccggctgggacacccggatcaccctcgaggacctgaagaacgaggagatggtgaccaaccacatgaagggggagcacaagaagctggccgaggccatcttcaagctcacgtaccagaacaaggtggtccgcgtgcagcgcccgacgccccggggcaccgtgatggacatcatcagccgcaaggaccagcggggctccgggcaggtcggcacctacgggctgaacacgttcaccaacatggaggcgcagctgatccgccagatggagggcgagggcatcttcaagagcatccagcacctcaccgtgaccgaggagatcgccgtgcagaactggctggcccgggtcgggcgcgagcggctgtcccgcatggccatcagcggcgacgactgcgtggtgaagcccctcgacgaccggttcgcctccgcgctgacggccctgaacgacatggggaaggtccgcaaggacatccagcagtgggagcccagccggggctggaacgactggacccaggtgccgttctgctcccaccacttccacgagctcgtgatgaaggacgggcgcgtcctggtggtgccctgccggaaccaggacgagctgatcggccgcgcccggatcagccagggcgccgggtggtccctcaaggagaccgcctgcctgggcaagagctacgcgcagatgtggaccctgatgtacttccaccgccgggacctccgcctggccgccaacgccatctgctccgccgtccccagccactgggtgcccacgtcccggaccacctggagcatccacgcgaagcacgagtggatgaccaccgaggacatgctggccgtgtggaaccgcgtctggatccaggagaacccgtggatggaggacaagacgcccgtggagtcctgggaggaggtgccctacctcgggaagcgcgaggaccagtggtgcggcagcctgatcgggctgaccagccgggccacctgggccaagaacatccagaccgcgatcaaccaggtccgctccctcatcggcaacgaggagtacacggactacatgcccagcatgaagcggttccgcaaggaggaggaggaggccggcgtgctgtggtga

SEQ ID NO: 9416 - RNA, 9876 nt, synthetic construct
  misc_feature 1..9876: note = derived and/or modified CDS sequence (opt1) from DENV-2__EU677144__SS-prME
  source 1..9876: mol_type = other RNA
accgccggcatgatcatcatgctgatccccaccgccatggcgttccacctcaccacccgcaacggggagccgcacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccaccagcacctgggtgacctacgggacctgcaccaccacgggcgagcaccggcgcgagaagcggtccgtggccctggtcccccacgtggggatgggcctcgagacccgcaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtcgcgcccagcatgaccatgcgctgcatcggcatctccaaccgggacttcgtggagggcgtgagcgggggctcctgggtcgacatcgtgctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcgggctgttcggcaagggcggcatcgtgacctgcgcgatgttcacgtgcaagaagaacatggagggcaaggtggtcctgcccgagaacctggagtacaccatcgtgatcacgccccacagcggggaggagcacgccgtgggcaacgacaccgggaagcacggcaaggagatcaagatcaccccgcagtccagcatcaccgaggccgagctcaccgggtacggcacggtcaccatggagtgcagcccccggaccggcctggacttcaacgagatggtgctgctccagatggaggacaaggcctggctggtgcaccggcagtggttcctggacctccccctgccctggctgccgggggccgacacccagggcctcaactggatccagaaggagacgctggtcaccttcaagaacccccacgcgaagaagcaggacgtggtggtcctggggagccaggagggcgccatgcacaccgccctcaccggggccacggagatccagatgtccagcggcaacctgctgttcaccggccacctcaagtgccgcctgcggatggacaagctgcagctcaaggggatgagctactccatgtgcaccggcaagttcaagatcgtgaaggagatcgccgagacccagcacgggacgatcgtcatccgcgtgcagtacgagggcgacggcagcccctgcaagatccccttcgagatcatggacctggagaagcggtacgtgctggggcgcctcatcaccgtcaacccgatcgtgaccgagaaggactcccccgtgaacatcgaggcggagccgcccttcggcgacagctacatcatcatcggggtcgagccgggccagctgaagctgaactggttcaagaaggggtccagcatcggccagatgttcgagaccacgatgcgcggcgccaagcggatggccatcctcggggacaccgcctgggacttcggctccctcgggggcgtgttcaccagcatcgggaaggccctgcaccaggtgttcggcgcgatctacggcgccgccttctccggggtcagctggaccatgaagatcctgatcggcgtgatcatcacgtggatcgggatgaactcccgcagcacctccctcagcgtgtccctggtcctggtgggcgtggtcaccctctacctgggggtgatggtgcaggccgacagcggctgcgtcgtgtcctggaagaacaaggagctgaagtgcggcagcgggatcttcatcaccgacaacgtgcacacgtggaccgagcagtacaagttccagcccgagtcccccagcaagctcgcgagcgccatccagaaggcccacgaggagggcatctgcgggatccggtccgtcacccgcctggagaacctgatgtggaagcagatcacccccgagctcaaccacatcctgagcgagaacgaggtgaagctgacgatcatgaccggcgacatcaaggggatcatgcaggccggcaagcggtccctccgcccgcagcccaccgagctgaagtacagctggaagacctggggcaaggccaagatgctgtccacggagagccacaaccagaccttcctcatcgacgggcccgagaccgcggagtgcccgaacaccaaccgggcctggaactccctggaggtggaggactacggcttcggggtcttcagcacgaacatctggctgaagctccgcgagaagcaggacgtgttctgcgactccaagctgatgagcgccgccatcaaggacaaccgggccgtgcacgcggacatgggctactggatcgagtccgccctgaacgacacctggaagatggagaaggccagcttcatcgaggtcaagtcctgccactggcccaagagccacaccctctggtccaacggcgtgctggagagcgagatgatcatccccaagaacttcgccgggcccgtgtcccagcacaactaccgcccgggctaccacacccagaccgccgggccctggcacctgggcaagctcgagatggacttcgacttctgcgaggggacgaccgtcgtggtgaccgaggactgcggcaaccggggccccagcctgcgcaccacgaccgcgagcgggaagctgatcaccgagtggtgctgccggtcctgcaccctcccgcccctgcgctaccggggcgaggacgggtgctggtacggcatggagatccgccccctgaaggagaaggaggagaacctcgtcaacagcctggtgacggccgggcacggccagatcgacaacttctccctgggcgtgctcgggatggccctgttcctggaggagatgctccggacccgcgtcggcaccaagcacgccatcctgctggtggcggtgagcttcgtcaccctcatcacggggaacatgtccttccgggacctgggccgcgtgatggtgatggtcggggccaccatgaccgacgacatcggcatgggcgtgacctacctggccctcctggccgccttcaaggtgcgccccacgttcgcggccgggctgctcctgcggaagctgaccagcaaggagctcatgatggccaccatcggcatcgccctgctgtcccagagcaccatccccgagacgatcctcgagctgaccgacgccctggcgctcgggatgatggtcctgaagatcgtgcgcaacatggagaagtaccagctggccgtgaccatcatggccatcctctgcgtccccaacgccgtgatcctgcagaacgcctggaaggtgtcctgcaccatcctggcggccgtcagcgtgagccccctcctgctgacgagctcccagcagaaggccgactggatccccctcgccctgaccatcaagggcctgaaccccaccgcgatcttcctcaccacgctgagccggacctccaagaagcgcagctggccgctgaacgaggccgtcatggccgtgggcatggtgtccatcctcgccagctccctgctgaagaacgacatccccatgaccgggcccctcgtcgccggcgggctgctgaccgtgtgctacgtgctcacgggccggagcgcggacctggagctggagcgcgccgccgacgtcaagtgggaggaccaggccgagatcagcgggtccagccccatcctctccatcaccatcagcgaggacggctccatgagcatcaagaacgaggaggaggagcagaccctgaccatcctgatccggacgggcctcctggtgatctccggggtgttcccggtcagcatccccatcaccgccgcggcctggtacctgtgggaggtgaagaagcagcgcgccggcgtgctctgggacgtccccagcccgccgcccatggagaaggccgagctggaggacggggcctaccggatcaagcagcgcggcatcttcgggtacagccagatcggcgcgggcgtgtacaaggaggggaccttccacaccatgtggcacgtgacccggggcgccgtcctgatgcaccgcgggaagcggatcgagccctcctgggccgacgtgaagaaggacctcatcagctacggcgggggctggaagctggagggcgagtggaaggagggggaggaggtgcaggtcctggccctcgagcccggcaagaacccccgcgccgtgcagacgaagcccgggctgttcaagaccaacaccggcaccatcggggcggtgtccctggacttcagccccggcacgtccggcagccccatcgtcgaccggaaggggaaggtggtgggcctctacgggaacggcgtcgtgacccgctccggcgcctacgtgagcgccatcgcccagaccgagaagtccatcgaggacaaccccgagatcgaggacgacatcttccggaagaagcgcctgaccatcatggacctgcaccccggggcgggcaagacgaagcggtacctgcccgccatcgtccgcgaggccatcaagcgggggctccgcaccctgatcctggccccgacccgcgtggtggccgcggagatggaggaggccctccggggcctgcccatccgctaccagacccccgccatccgggccgagcacacggggcgcgagatcgtcgacctgatgtgccacgccaccttcaccatgcggctcctgagccccgtgcgcgtgccgaactacaacctgatcatcatggacgaggcgcacttcaccgaccccgccagcatcgccgcccggggctacatctccacgcgcgtcgagatgggcgaggccgcggggatcttcatgaccgccacgccgcccggcagccgggacccgttcccccagtccaacgcccccatcatggacgaggagcgcgagatccccgagcggagctggaactccgggcacgagtgggtgaccgacttcaagggcaagacggtgtggttcgtcccgagcatcaaggccgggaacgacatcgcggcctgcctccgcaagaacggcaagaaggtgatccagctgtcccggaagaccttcgacagcgagtacgtgaagacccgcgccaacgactgggacttcgtcgtgaccacggacatctccgagatgggcgccaacttccgggccgagcgcgtgatcgacccccggcgctgcatgaagcccgtcatcctgaccgacggggaggagcgggtgatcctcgcgggccccatgccggtgacccacagctccgccgcccagcgccgcgggcggatcggccgcaaccccaagaacgagaacgaccagtacatctacatgggggagcccctggagaacgacgaggactgcgcccactggaaggaggccaagatgctgctcgacaacatcaacacccccgagggcatcatcccgagcatgttcgagcccgagcgggagaaggtcgacgcgatcgacggcgagtaccgcctgcgcggggaggcccgcaagacgttcgtggacctgatgcggcgcggcgacctccccgtgtggctggcctaccgggtcgccgccgaggggatcaactacgcggaccgccggtggtgcttcgacggcatcaagaacaaccagatcctggaggagaacgtggaggtggagatctggaccaaggagggggagcgcaagaagctcaagccgcggtggctggacgcccgcatctactccgaccccctggccctcaaggagttcaaggagttcgccgcgggccggaagtccctgaccctgaacctcatcaccgagatgggccgcctgcccacgttcatgacccagaaggcccgggacgccctggacaacctcgccgtcctgcacaccgccgaggtcgggggccgcgcgtacaaccacgccctgtccgagctccccgagaccctggagacgctgctcctgctgaccctcctggccaccgtcaccgggggcatcttcctgttcctcatgagcggcaaggggatcggcaagatgacgctggggatgtgctgcatcatcaccgcctccatcctgctctggtacgcccagatccagccgcactggatcgcggccagcatcatcctggagttcttcctgatcgtgctcctgatccccgagcccgagaagcagcggacgccccaggacaaccagctgacctacgtggtcatcgccatcctcaccgtggtggccgccacgatggcgaacgagatgggcttcctggagaagaccaagaaggacctggggctcggctccatcatcacccaggagagcgagagcaacatcctggacatcgacctgcgcccggcctccgcctggaccctctacgccgtcgccacgaccttcgtgacccccatgctgcggcacagcatcgagaactccagcgtgaacgtctccctgaccgcgatcgccaaccaggccacggtgctcatgggcctggggcgcggctggcccctgagcaagatggacatcggggtgcccctcctggccatcggctgctactcccaggtcaacccgatcaccctgaccgcggccctcctgctgctcgtggcccactacgccatcatcgggcccggcctgcaggccaaggcgacccgcgaggcccagaagcgggccgccgccggcatcatgaagaaccccacggtggacgggatcaccgtcatcgacctggagcccatcccgtacgaccccaagttcgagaagcagctcggccaggtgatgctgctggtgctctgcgtcacccaggtgctgatgatgcgcaccacgtgggcgctgtgcgaggccctcaccctggccaccgggcccatcagcaccctgtgggagggcaaccccgggcggttctggaacacgaccatcgccgtgtccatggccaacatcttccgcggcagctacctcgcgggcgccgggctgctgttctccatcatgaagaacaccaccaacacgcggcgcggcaccgggaacatcggcgagaccctcggcgagaagtggaagtcccggctgaacgccctgggcaagagcgagttccagatctacaagaagtccgggatccaggaggtcgaccgcaccctcgccaaggaggggatcaagcggggcgagacggaccaccacgcggtgtcccgcgggagcgccaagctgcggtggttcgtggagcgcaacatggtcaccccggagggcaaggtggtggacctgggctgcgggcggggcgggtggtcctactactgcggcgggctcaagaacgtccgcgaggtgaagggcctgaccaagggcgggcccggccacgaggagcccatccccatgagcacctacgggtggaacctggtgcggctccagtccggcgtcgacgtgttcttcacgccgcccgagaagtgcgacaccctgctgtgcgacatcggggagagcagccccaaccccaccatcgaggccggccgcaccctccgggtgctgaacctggtcgagaactggctcaacaacaacacgcagttctgcatcaaggtgctgaacccgtacatgccctccgtgatcgagaagatggagaccctgcagcgcaagtacggcggggccctggtccggaaccccctcagccgcaactccacccacgagatgtactgggtgagcaacgccaccggcaacatcgtgtccagcgtcaacatgatctcccgcatgctgatcaaccggttcaccatgaagcacaagaaggcgacgtacgagccggacgtggacctggggagcggcacccgcaacatcgggatcgagaacgagatccccaacctcgacatcatcggcaagcggatcgagaagatcaagcaggagcacgagacctcctggcactacgaccaggaccacccctacaagacctgggcctaccacggcagctacgagacgaagcagaccgggtccgccagctccatggtgaacggcgtcgtgcgcctgctgaccaagccctgggacgtggtcccgatggtgacccagatggccatgacggacaccacccccttcgggcagcagcgggtgttcaaggagaaggtcgacacccgcacgcaggagcccaaggagggcaccaagaagctcatgcggatcaccgccgagtggctgtggaaggagctgggcaagaagaagacgccccgcatgtgcacgcgggaggagttcacccgcaaggtgcggagcaacgcggccctcggggccatcttcaccgacgagaacaagtggaagtccgcccgcgaggccgtggaggacagccggttctgggagctggtcgaccgcgagcggaacctgcacctcgagggcaagtgcgagacctgcgtgtacaacatgatggggaagcgcgagaagaagctgggcgagttcgggaaggcgaagggctcccgggccatctggtacatgtggctgggcgcccgcttcctcgagttcgaggccctggggttcctgaacgaggaccactggttcagccggggcaactccctcagcggggtcgagggcgaggggctgcacaagctgggctacatcctccgcgacgtgagcaagaaggagggcggggcgatgtacgccgacgacacggccggctgggacacccggatcaccctggaggacctgaagaacgaggagatggtgaccaaccacatgaagggggagcacaagaagctcgccgaggccatcttcaagctgacgtaccagaacaaggtcgtgcgcgtgcagcgcccgacgccccggggcaccgtcatggacatcatctcccgcaaggaccagcgggggagcggccaggtgggcacctacgggctgaacaccttcaccaacatggaggcgcagctcatccgccagatggagggcgaggggatcttcaagtccatccagcacctgaccgtgaccgaggagatcgccgtccggaactggctggcccgcgtgggccgggagcgcctcagccggatggccatctccggcgacgactgcgtggtcaagcccctggacgaccgcttcgccagcgcgctgacggccctcaacgacatggggaaggtgcggaaggacatccagcagtgggagccctcccgcggctggaacgactggacccaggtgccgttctgcagccaccacttccacgagctggtcatgaaggacgggcgggtgctggtggtcccctgccgcaaccaggacgagctcatcggccgggcccgcatctcccagggggccggctggagcctgaaggagaccgcctgcctgggcaagtcctacgcgcagatgtggaccctcatgtacttccaccggcgcgacctgcggctggccgccaacgccatctgcagcgccgtgccctcccactgggtgcccacgagccgcaccacctggtccatccacgcgaagcacgagtggatgaccaccgaggacatgctcgccgtctggaaccgcgtgtggatccaggagaacccgtggatggaggacaagacgcccgtggagagctgggaggaggtcccctacctggggaagcgggaggaccagtggtgcggctccctgatcgggctcaccagccgcgccacctgggccaagaacatccagaccgcgatcaaccaggtgcggagcctgatcggcaacgaggagtacacggactacatgccctccatgaagcgcttccggaaggaggaggaggaggccggggtgctgtggtga

SEQ ID NO: 9417 - RNA, 9876 nt, synthetic construct
  misc_feature 1..9876: note = derived and/or modified CDS sequence (opt1) from DENV-2__EU677145__SS-prME
  source 1..9876: mol_type = other RNA
accgccggcgtcatcgtcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtggtgcagcccgagaacctggagtacaccatcgtcatcacgccccacagcggggaggagcacgccgtgggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtcctgctgcagatggaggacaaggcctggctcgtgcaccggcagtggttcctggacctgcccctcccctggctgccgggggccgacacccagggcagcaactggatccagaaggagacgctggtgaccttcaagaacccccacgcgaagaagcaggacgtcgtggtcctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcatcaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtgttcacctccatcgggaaggccctccaccaggtcttcggggcgatctacggcgccgccttcagcggggtgtcctggacgatgaagatcctgatcggcgtgatcatcacctggatcgggatgaacagccgctccaccagcctgtccgtcagcctggtgctcgtgggcgtcgtgaccctgtacctgggggccatggtgcaggcggactccggctgcgtcgtgagctggaagaacaaggagctcaagtgcggctccgggatcttcatcacggacaacgtgcacacctggaccgagcagtacaagttccagcccgagagccccagcaagctggcctccgccatccagaaggcccacgaggagggcatctgcgggatccggagcgtcacccgcctggagaacctcatgtggaagcagatcacgcccgagctgaaccacatcctgtccgagaacgaggtgaagctcaccatcatgaccggcgacatcaaggggatcatgcaggccggcaagcggagcctgcgcccgcagcccaccgagctgaagtactcctggaagacgtggggcaaggcgaagatgctcagcaccgagtcccacaaccagaccttcctgatcgacgggcccgagaccgccgagtgcccgaacacgaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacaccctgtggtccaacggcgtgctggagagcgagatgatcatccccaagtccttcgccgggcccgtgagccagcacaactaccgcccgggctaccacacgcagaccgcggggccctggcacctcggcaagctggagatggacttcgacttctgcgaggggaccaccgtcgtggtgacggaggactgcggcaaccggggccccagcctgcgcaccaccaccgcctccgggaagctcatcacggagtggtgctgccggagctgcaccctgcccccgctgcgctaccggggcgaggacgggtgctggtacggcatggagatccgccccctcaaggagaaggaggagaacctggtcaactccctggtgaccgccgggcacggccagatcgacaacttcagcctcggcgtgctggggatggccctgttcctcgaggagatgctgcggacccgcgtcggcacgaagcacgcgatcctgctcgtggccgtgtccttcgtcaccctgatcaccgggaacatgagcttccgggacctgggccgcgtgatggtgatggtcggggccaccatgacggacgacatcggcatgggcgtgacctacctcgccctgctggccgcgttcaaggtgcgccccaccttcgccgccgggctcctgctgcggaagctcacctccaaggagctgatgatggccacgatcggcatcgccctgctcagccagtccaccatgcccgagaccatcctggagctgaccgacgcgctcgccctggggatgatggtcctgaagatcgtgcgcaacatggagaagtaccagctcgccgtgacgatcatggccatcagctgcgtcccgaacgccgtgatcctgcagaacgcgtggaaggtgtcctgcaccatcctggccaccgtcagcgtgagccccctcctgctgaccagctcccagcagaaggccgactggatccccctcgccctgacgatcaagggcctgaaccccaccgcgatcttcctcaccaccctgagccggacgtccaagaagcgcagctggccgctgaacgaggccatcatggccgtcggcatggtgtccatcctcgccagcagcctgctgaagaacgacatccccatgaccgggcccctcgtggccggcgggctgctgaccgtctgctacgtgctcaccggccggtccgcggacctggagctggagcgcgccgccgacgtgaagtgggaggaccaggccgagatcagcgggtccagccccatcctctccatcacgatcagcgaggacggctccatgagcatcaagaacgaggaggaggagcagaccctgaccatcctgatccggaccggcctcctggtcatctccggggtgttcccggtgagcatccccatcaccgccgcggcctggtacctgtgggaggtcaagaagcagcgcgccggcgtgctctgggacgtgcccagcccgccgcccgtcgggaaggccgagctggaggacggcgcctaccggatcaagcagcgcgggatcctgggctacagccagatcggcgcgggggtgtacaaggagggcacgttccacaccatgtggcacgtgacccgcggggccgtcctcatgcaccgcggcaagcggatcgagccctcctgggccgacgtgaagaaggacctgatcagctacgggggcggctggaagctggagggggagtggaaggagggcgaggaggtgcaggtcctcgccctggagcccgggaagaacccccgcgccgtgcagaccaagcccggcatcttcaagacgaacaccgggaccatcggcgcggtgtccctggacttcagccccggcacctccgggagccccatcgtcgaccggaagggcaaggtggtggggctctacggcaacggcgtcgtgacgcgctccggggcctacgtgagcgccatcgcccagaccgagaagtccatcgaggacaaccccgagatcgaggacgacatcttccggaagaagcgcctgaccatcatggacctgcaccccggcgcggggaagaccaagcggtacctccccgccatcgtccgcgaggccatcaagcggggcctgcgcacgctgatcctggccccgacccgcgtggtggccgcggagatggaggaggccctccgggggctgcccatccgctaccagacccccgccatccgggccgagcacaccggccgcgagatcgtcgacctgatgtgccacgccacgttcaccatgcggctcctgtcccccgtgcgcgtgccgaactacaacctgatcatcatggacgaggcgcacttcaccgaccccgccagcatcgccgcccggggctacatctccacccgcgtcgagatgggggaggccgcgggcatcttcatgacggccacgccgcccgggagccgggacccgttcccccagtccaacgcccccatcatggacgaggagcgcgagatccccgagcggagctggaactccggccacgagtgggtgaccgacttcaaggggaagaccgtgtggttcgtcccgagcatcaaggccggcaacgacatcgcggcctgcctccgcaagaacggcaagaaggtgatccagctgtcccggaagacgttcgacagcgagtacgtgaagacccgcgccaacgactgggacttcgtcgtgaccaccgacatctccgagatgggggccaacttcaaggccgagcgggtgatcgacccccgccggtgcatgaagcccgtcatcctgacggacggcgaggagcgcgtgatcctcgcggggcccatgccggtgacccacagctccgccgcccagcggcgcggccgcatcgggcggaaccccaagaacgagaacgaccagtacatctacatgggcgagcccctggagaacgacgaggactgcgcccactggaaggaggccaagatgctgctcgacaacatcaacacccccgagggcatcatcccgagcatgttcgagcccgagcgcgagaaggtcgacgcgatcgacggggagtaccggctgcgcggcgaggcccggaagaccttcgtggacctgatgcgccgcggggacctccccgtgtggctggcctaccgcgtcgccgccgagggcatcaactacgcggaccggaagtggtgcttcgacgggatcaagaacaaccagatcctggaggagaacgtggaggtggagatctggacgaaggagggcgagcgcaagaagctcaagccgcggtggctggacgcccgcatctactccgaccccctggccctcaaggagttcaaggagttcgccgcgggccggaagtccctgaccctgaacctcatcaccgagatggggcgcctgcccaccttcatgacgcagaaggcccggaacgccctggacaacctcgccgtcctgcacaccgccgaggcgggcgggcgcgcctacaaccacgccctgtccgagctccccgagaccctggagaccctgctcctgctgacgctcctggccaccgtgaccggcggcatcttcctgttcctcatgagcgggaagggcatcgggaagatgaccctgggcatgtgctgcatcatcaccgcctccatcctgctctggtacgcgcagatccagccgcactggatcgccgccagcatcatcctggagttcttcctgatcgtcctcctgatccccgagcccgagaagcagcggacgccccaggacaaccagctgacctacgtggtgatcgccatcctcaccgtcgtggccgcgaccatggccaacgagatggggttcctggagaagacgaagaaggacctgggcctcggcagcatcaccacccaggagtccgagagcaacatcctggacatcgacctgcgcccggcctccgcctggaccctctacgccgtggcgacgaccttcgtcacccccatgctgcggcacagcatcgagaactccagcgtgaacgtgtccctgaccgccatcgccaaccaggccacggtcctcatggggctgggcaaggggtggcccctgagcaagatggacatcggcgtgcccctcctggcgatcgggtgctactcccaggtgaacccgatcaccctgaccgccgccctcctgctgctcgtcgcccactacgccatcatcggccccggcctgcaggcgaaggccacccgcgaggcccagaagcgggccgccgcggggatcatgaagaaccccacggtggacggcatcaccgtgatcgacctggagcccatcccgtacgaccccaagttcgagaagcagctcgggcaggtcatgctgctgatcctctgcgtgacccaggtgctgatgatgcgcaccacgtgggccctgtgcgaggccctcaccctggccaccggccccatcagcaccctgtgggaggggaaccccggccgcttctggaacacgaccatcgccgtctccatggcgaacatcttccggggcagctacctcgccggggccggcctgctgttctccatcatgaagaacaccaccaacacgcgccgggggaccggcaacatcggcgagaccctcggggagaagtggaagtcccgcctgaacgccctgggcaagtccgagttccagatctacaagaagtccgggatccaggaggtggaccggaccctcgcgaaggagggcatcaagcgcggggagacggaccaccacgccgtgtcccggggcagcgccaagctgcgctggttcgtcgagcggaacatggtgaccccggagggcaaggtggtcgacctggggtgcggccgcgggggctggtcctactactgcgggggcctcaagaacgtgcgggaggtgaagggcctgaccaagggcgggcccgggcacgaggagcccgtccccatgagcacctacggctggaacctggtgcgcctccagagcggggtggacgtcttcttcacgccgcccgagaagtgcgacaccctgctgtgcgacatcggcgagtccagccccaaccccaccatcgaggccggccggaccctccgcgtgctgaacctggtggagaactggctcaacaacaacacccagttctgcatcaaggtcctgaacccgtacatgccctccgtgatcgagaagatggagacgctgcagcggaagtacgggggcgccctcgtgcgcaaccccctgagccggaactccacccacgagatgtactgggtcagcaacgcgaccgggaacatcgtgtccagcgtgaacatgatctcccgcatgctgatcaaccggttcaccatgaagcacaagaaggccacgtacgagccggacgtcgacctgggcagcgggacccgcaacatcggcatcgagtccgagatccccaacctcgacatcatcggcaagcgcatcgagaagatcaagcaggagcacgagaccagctggcactacgaccaggaccacccctacaagacctgggcctaccacgggtcctacgagacgaagcagaccggcagcgcctccagcatggtgaacggggtggtccggctgctgaccaagccctgggacgtggtgccgatggtcacccagatggccatgacggacaccacccccttcggccagcagcgcgtgttcaaggagaaggtggacacccggacgcaggagcccaaggagggcaccaagaagctcatgaagatcaccgcggagtggctgtggaaggagctggggaagaagaagacgccccggatgtgcacgcgggaggagttcaccaagaaggtccgctccaacgccgccctcggcgccatcttcaccgacgagaacaagtggaagtccgcccgggaggcggtggaggacgggcgcttctgggagctggtggaccgggagcgcaacctgcacctcgagggcaagtgcgagacctgcgtctacaacatgatggggaagcgggagaagaagctgggcgagttcggcaaggccaaggggtcccgcgccatctggtacatgtggctgggcgcccggttcctcgagttcgaggcgctggggttcctgaacgaggaccactggttcagccgcggcaacagcctctccggggtggagggcgagggcctgcaccggctggggtacatcctccgcgaggtcggcaagaaggagggcggcgccatgtacgccgacgacacggccgggtgggacacccggatcaccctggaggacctgaagaacgaggagatggtgaccaaccacatgaagggcgagcacaagaagctcgccgaggcgatcttcaagctgacgtaccagaacaaggtggtccgcgtgcagcggccgacgccccgcggcaccgtgatggacatcatcagccggcgcgaccagcgcgggtccggccaggtcgggacctacggcctgaacacgttcaccaacatggaggcccagctcatccggcagatggagggcgaggggatcttcaagagcatccagcacctgaccgccaccgaggagatcgccgtgcagaactggctggcccgcgtgggccgggagcgcctctcccggatggcgatcagcggggacgactgcgtcgtgaagcccatcgacgaccgcttcgcctccgccctgacggccctgaacgacatgggcaaggtgcggaaggacatccagcagtgggagcccagccgcgggtggaacgactggacccaggtcccgttctgctcccaccacttccacgagctcgtgatgaaggacggccgggtgctggtcgtgccctgccgcaaccaggacgagctgatcggccgggcccgcatcagccagggggcgggctggtccctcaaggagaccgcctgcctgggcaagagctacgcccagatgtggaccctgatgtacttccaccggcgcgacctccggctggccgccaacgcgatctgctccgccgtgcccagccactgggtccccacctcccgcacgacctggagcatccacgccaagcacgagtggatgaccaccgaggacatgctggccgtgtggaaccgggtgtggatccaggagaacccgtggatggaggacaagacgcccgtcgagtcctgggaggaggtgccctacctcggcaagcgcgaggaccagtggtgcgggagcctgatcggcctgaccagccgggcgacctgggccaagaacatccagaccgccatcaaccaggtgcgctccctcatcggcaacgaggagtacacggactacatgcccagcatgaagcgcttccggcgcgaggaggaggaggccggggtcctgtggtga

SEQ ID NO: 9418 - RNA, 9876 nt, synthetic construct
  misc_feature 1..9876: note = derived and/or modified CDS sequence (opt1) from DENV-2__EU677146__SS-prME
  source 1..9876: mol_type = other RNA
accgtgggcgtgatcgtgatgctgatccccaccgccatggccttccacctcaccacccgcaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtggccctggtcccccacgtggggatgggcctcgagacccgcaccgagacctggatgagcagcgagggggcctggaagcacgtgcagcggatcgagacctggatcctgcgccacccgggcttcaccatcatggccgccatcctggcgtacaccatcgggaccacccacttccagcgggccctcatcttcatcctgctgaccgccgtcgcccccagcatgaccatgcgctgcatcggcatctccaaccgggacttcgtggagggcgtgagcgggggctcctgggtcgacatcgtgctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcggcctgttcggcaagggcgggatcgtgacctgcgccatgttcacgtgcaagaagaacatggagggcaaggtggtcctgcccgagaacctggagtacaccatcgtgatcacgccccacagcggggaggagcacgcggtgggcaacgacaccgggaagcacggcaaggagatcaagatcaccccgcagtccagcatcaccgaggccgagctcaccgggtacggcacggtcaccatggagtgcagcccccggaccggcctggacttcaacgagatggtgctgctccagatggaggacaaggcctggctggtgcaccggcagtggttcctggacctccccctgccctggctgccgggggccgacacccagggcagcaactggatccagaaggagacgctcgtcaccttcaagaacccccacgccaagaagcaggacgtggtcgtgctggggtcccaggagggcgcgatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtcatccgcgtgcagtacgagggcgacggctccccctgcaagatccccttcgagatcatggacctcgagaagcggcacgtgctggggcgcctgatcaccgtcaacccgatcgtgaccgagaaggacagccccgtgaacatcgaggccgagccgcccttcggcgactcctacatcatcatcggggtcgagccgggccagctcaagctgaactggttcaagaaggggagctccatcggccagatgttcgagaccacgatgcgcggcgcgaagcggatggccatcctgggggacaccgcctgggacttcggcagcctcgggggcgtgttcacctccatcgggaaggccctgcaccaggtgttcggcgccatctacggcgcggccttcagcggggtctcctggaccatgaagatcctgatcggcgtgatcatcacgtggatcgggatgaacagccgctccaccagcctgtccgtgagcctcgtcctggtgggcgtggtcaccctgtacctcggggtgatggtgcaggccgactccggctgcgtcgtgagctggaagaacaaggagctgaagtgcggctccgggatcttcatcaccgacaacgtgcacacgtggaccgagcagtacaagttccagcccgagagccccagcaagctggcctccgcgatccagaaggcccacgaggagggcatctgcgggatccggagcgtcacccgcctcgagaacctgatgtggaagcagatcacccccgagctgaaccacatcctctccgagaacgaggccaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtggaggactacggcttcggggtgttctccacgaacatctggctgaagctgcgcgagaagcaggacgtcttctgcgacagcaagctcatgtccgccgccatcaaggacaaccgggccgtgcacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtcagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcggaccgccgccgggatcatgaagaaccccaccgtggacggcatcaccgtgatcgacctcgagcccatcccgtacgaccccaagttcgagaagcagctggggcaggtcatgctgctcgtgctgtgcgtgacgcaggtcctgatgatgcgcaccacctgggccctctgcgaggcgctgaccctggccacgggccccatcagcaccctctgggaggggaaccccggccggttctggaacaccaccatcgccgtgtccatggccaacatcttccgcggcagctacctggccggggcgggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtctcccgcggcagcgcgaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgacgaagggcgggcccgggcacgaggagcccatccccatgagcacctacggctggaacctcgtgcggctgcagagcggggtggacgtcttcttcaccccgcccgagaagtgcgacaccctgctctgcgacatcggcgagtccagccccaaccccacgatcgaggccggccgcaccctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccacggggaacatcgtgtccagcgtgaacatgatctcccgcatgctgatcaaccggttcaccatgaagcacaagaaggccacctacgagccggacgtcgacctcggcagcgggacccgcaacatcggcatcgagaacgagatccccaacctggacatcatcggcaagcggatcgagaagatcaagcaggagcacgagacgtcctggcactacgaccaggaccacccctacaagacctgggcgtaccacgggagctacgagaccaagcagaccggctccgccagctccatggtgaacggggtggtcaagctgctcacgaagccctgggacgtggtgccgatggtcacccagatggccatgaccgacaccacgcccttcggccagcagcgcgtgttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtccgcagcaacgccgcgctgggcgccatcttcacggacgagaacaagtggaagtccgcccgggaggccgtggaggacagccgcttctgggagctggtcgaccgggagcgcaacctccacctggaggggaagtgcgagacctgcgtgtacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtcagcaagaaggagggcggcgccatgtacgcggacgacaccgccgggtgggacacccgcatcacgctggaggacctcaagaacgaggagatggtgaccaaccacatgaagggcgagcacaagaagctggccgaggccatcttcaagctgacctaccagaacaaggtggtccgggtgcagcgcccgacgccccgggggacggtgatggacatcatctcccggaaggaccagcgcggcagcggccaggtcgggacctacggcctcaacaccttcaccaacatggaggcccagctgatccggcagatggagggggagggcatcttcaagtccatccagcgcctgacggtgaccgaggagatcgcggtgcagaactggctcgcccgggtcggccgcgagcggctgagccgcatggccatctccggggacgactgcgtggtgaagcccctggacgaccggttcgccagcgccctcaccgcgctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgccggctggagcctgaaggagacggcctgcctcgggaagtcctacgcccagatgtggaccctgatgtacttccaccgccgggacctgcgcctcgcggccaacgccatctgcagcgccgtcccctcccactgggtgcccaccagccggaccacctggtccatccacgccaagcacgagtggatgacgaccgaggacatgctggcggtgtggaaccgcgtctggatccaggagaacccgtggatggaggacaagacccccgtggagagctgggaggaggtgccctacctgggcaagcgcgaggaccagtggtgcgggagcctcatcggcctgacctcccgggccacgtgggccaagaacatccagaccgccatcaaccaggtccgcagcctgatcgggaacgaggagtacaccgactacatgccctccatgaagcggttccgcaaggaggaggaggaggcgggcgtgctctggtga

SEQ ID NO: 9419 - RNA, 9876 nt, synthetic construct
  misc_feature 1..9876: note = derived and/or modified CDS sequence (opt1) from DENV-2__EU687214__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctactcccagatcggcgcgggggtgtacaaggagggcaccttccacaccatgtggcacgtcacgcgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgccgtgcagaccaagcccggcctgttcaagaccaacaccgggacgatcggcgcggtcagcctcgacttctcccccggcaccagcgggtcccccatcgtggaccggaagggcaaggtggtcgggctgtacggcaacggcgtggtgacccgcagcggggcctacgtctccgccatcgcccagaccgagaagtccatcgaggacaaccccgagatcgaggacgacatcttccggaagaagcgcctgacgatcatggacctccaccccggcgcggggaagaccaagcggtacctgcccgccatcgtgcgcgaggccatcaagcggggcctgcgcaccctgatcctcgccccgacccgcgtggtcgccgcggagatggaggaggccctgcgggggctgcccatccgctaccagacgcccgccatccgggccgagcacaccggccgcgagatcgtggacctcatgtgccacgccaccttcaccatgcggctgctgagccccgtgcgcgtcccgaactacaacctcatcatcatggacgaggcgcacttcacggaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgacgaacttcaaggggaagaccgtctggttcgtgccgtccatcaaggccggcaacgacatcgcggcctgcctgcgcaagaacggcaagaaggtgatccagctgagccggaagaccttcgactccgagtacgtcaagacccgcgccaacgactgggacttcgtggtgacgaccgacatcagcgagatgggggccaacttccgggccgagcgcgtcatcgacccccggcgctgcatgaagcccgtgatcctcaccgacggcgaggagcgggtgatcctggcggggcccatgccggtcacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaaggcccgggacgccctcgacaacctggccgtgctgcacaccgccgaggtcggcgggcgcgcgtacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgacggtggtcgccgccaccatggcgaacgagatggggttcctggagaagaccaagaaggacctcggcctgggcagcatcaccacgcaggagagcgagtccaacatcctggacatcgacctccgcccggccagcgcctggaccctgtacgccgtggccaccaccttcgtgacgcccatgctgcggcactccatcgagaacagctccgtcaacgtgagcctcaccgcgatcgccaaccaggccaccgtgctgatggggctgggccgcgggtggcccctctccaagatggacatcggcgtccccctgctggccatcgggtgctacagccaggtgaacccgatcaccctcacggcggccctgctgctcctggtggcccactacgccatcatcggccccggcctgcaggccaaggcgacccgcgaggcccagaagcggaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgacgctggccaccggccccatctccaccctctgggaggggaaccccggccggttctggaacaccacgatcgccgtcagcatggccaacatcttccgcggctcctacctggccggggcgggcctcctcttcagcatcatgaagaacaccaccaacacccggcgcgggacgggcaacatcggcgagaccctgggggagaagtggaagtcccggctgaacgccctcggcaagagcgagttccagatctacaagaagtccgggatccaggaggtggaccgcaccctggccaaggagggcatcaagcgcggggagaccgaccaccacgccgtgagccgcggctccgcgaagctgcggtggttcgtcgagcgcaacatggtgacgccggagggcaaggtggtcgacctcgggtgcggccgcggcgggtggagctactactgcggcgggctgaagaacgtgcgcgaggtgaaggggctgaccaagggcgggcccgggcacgaggagcccatccccatgtccacctacggctggaacctcgtccggctgcagagcggggtggacgtgttcttcaccccgcccgagaagtgcgacacgctgctctgcgacatcggcgagagctcccccaaccccaccatcgaggccggccgcaccctgcgggtcctgaacctcgtggagaactggctgaacaacaacacccagttctgcgtgaaggtcctgaacccgtacatgcccagcgtgatcgagaagatggagaccctccagcgcaagtacgggggcgccctggtgcggaaccccctgtcccgcaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctcggctccgggacgcgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagaccaagcagacgggcagcgcctccagcatggtgaacggggtggtcaagctgctcaccaagccctgggacgtggtgccgatggtcacccagatggccatgaccgacacgacccccttcggccagcagcgcgtgttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtccgctccaacgccgcgctgggcgccatcttcaccgacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtctccaagaaggagggcggggccatgtacgcggacgacaccgccgggtgggacacgcgcatcaccctggaggacctcaagaacgaggagatggtgaccaaccacatgaagggcgagcacaagaagctggccgaggccatcttcaagctgacctaccagaacaaggtggtccgggtgcagcgcccgacgccccgcgggaccgtgatggacatcatcagccggaaggaccagcgcggctccggccaggtcgggacctacggcctcaacaccttcacgaacatggaggcccagctgatccggcagatggagggggagggcatcttcaagagcatccagcgcctgaccgtgaccgaggagatcgcggtgcagaactggctcgcccgggtcggccgcgagcggctgtcccgcatggccatcagcggggacgactgcgtggtgaagcccctggacgaccggttcgcctccgccctcatcgcgctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcccggatcagccagggcgccggctggtccctgaaggagacggcctgcctcggcaagagctacgcccagatgtggaccctgatgtacttccaccgccgggacctgcgcctcgcggccaacgccatctgctccgccgtccccagccactgggtgcccacctcccggaccacctggagcatccacgccaagcacgagtggatgacgaccgaggacatgctggcggtgtggaaccgcgtctggatccaggagaacccgtggatggaggacaagacccccgtggagtcctgggaggaggtgccctacctgggcaagcgcgaggaccagtggtgcgggagcctcatcggcctgaccagccgggccacgtgggccaagaacatccagaccgccatcaaccaggtccgctccctgatcgggaacgaggagtacaccgactacatgcccagcatgaagcggttccgcaaggaggaggaggaggcgggcgtgctctggtga

SEQ ID NO: 9420 - RNA, 9876 nt, synthetic construct
  misc_feature 1..9876: note = derived and/or modified CDS sequence (opt1) from DENV-2__EU687215__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctactcccagatcggcgcgggggtgtacaaggagggcaccttccacaccatgtggcacgtcacgcgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgccgtgcagaccaagcccggcctgttcaagaccaagaccgggacgatcggcgcggtcagcctcgacttctcccccggcaccagcgggtcccccatcgtggaccggaagggcaaggtggtcgggctgtacggcaacggcgtggtgacccgcagcggggcctacgtctccgccatcgcccagaccgagaagtccatcgaggacaaccccgagatcgaggacgacatcttccggaagaagcgcctgacgatcatggacctccaccccggcgcggggaagaccaagcggtacctgcccgccatcgtgcgcgaggccatcaagcggggcctgcgcaccctgatcctcgccccgacccgcgtggtcgccgcggagatggaggaggccctgcgggggctgcccatccgctaccagacgcccgccatccgggccgagcacaccggccgcgagatcgtggacctcatgtgccacgccaccttcaccatgcggctgctgagccccgtgcgcgtcccgaactacaacctcatcatcatggacgaggcgcacttcacggaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggccggcaacgacatcgcggcctgcctgcgcaagaacggcaagaaggtgatccagctgagccggaagaccttcgactccgagtacgtcaagacccgcgccaacgactgggacttcgtggtgacgaccgacatcagcgagatgggggccaacttccgggccgagcgcgtcatcgacccccggcgctgcatgaagcccgtgatcctcaccgacggcgaggagcgggtgatcctggcggggcccatgccggtcacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaaggcccgggacgccctcgacaacctggccgtgctgcacaccgccgaggtcggcgggcgcgcgtacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgacggtggtcgccgccaccatggcgaacgagatggggttcctggagaagaccaagaaggacctcggcctgggcagcatcaccacgcaggagagcgagtccaacatcctggacatcgacctccgcccggccagcgcctggaccctgtacgccgtggccaccgcgttcgtgacccccatgctgcggcactccatcgagaacagctccgtcaacgtgagcctcacggccatcgccaaccaggccaccgtgctgatggggctgggccgcgggtggcccctctccaagatggacatcggcgtccccctgctggcgatcgggtgctacagccaggtgaacccgatcaccctcaccgccgccctgctgctcctggtggcccactacgccatcatcggccccggcctgcaggcgaaggccacgcgcgaggcccagaagcggaccgccgccgggatcatgaagaaccccaccgtcgacggcatcaccgtgatcgacctcgagcccatcccgtacgaccccaagttcgagaagcagctgggccaggtgatgctgctcgtcctgtgcgtgacccaggtgctgatgatgcgcaccacctgggcgctctgcgaggccctgaccctggccacgggccccatctccaccctctgggaggggaaccccggccggttctggaacaccaccatcgccgtcagcatggccaacatcttccgcggctcctacctggcgggggccggcctcctcttcagcatcatgaagaacacgaccaacacccggcgcgggaccggcaacatcggcgagacgctgggggagaagtggaagtcccggctgaacgccctcggcaagagcgagttccagatctacaagaagtccgggatccaggaggtggaccgcaccctggccaaggagggcatcaagcgcggggagaccgaccaccacgcggtgagccgcggctccgccaagctgcggtggttcgtcgagcgcaacatggtgaccccggagggcaaggtggtcgacctcgggtgcggccgcggcgggtggagctactactgcggcgggctgaagaacgtgcgcgaggtgaaggggctgacgaagggcgggcccgggcacgaggagcccatccccatgtccacctacggctggaacctcgtccggctgcagagcggggtggacgtgttcttcaccccgcccgagaagtgcgacaccctgctctgcgacatcggcgagagctcccccaaccccacgatcgaggccggccgcaccctgcgggtcctgaacctcgtggagaactggctgaacaacaacacccagttctgcgtgaaggtcctgaacccgtacatgcccagcgtgatcgagaagatggagaccctccagcgcaagtacgggggcgccctggtgcggaaccccctgtcccgcaacagcacccacgagatgtactgggtctccaacgccacggggaacatcgtgagctccgtgaacatgatcagccgcatgctgatcaaccggttcaccatgaagcacaagaaggcgacctacgagccggacgtcgacctcggctccgggacccgcaacatcggcatcgagaacgagatccccaacctggacatcatcggcaagcggatcgagaagatcaagcaggagcacgagacgagctggcactacgaccaggaccacccctacaagacctgggcctaccacgggtcctacgagaccaagcagaccggcagcgcctccagcatggtgaacggggtggtcaagctgctcacgaagccctgggacgtggtgccgatggtcacccagatggccatgaccgacaccacgcccttcggccagcagcgcgtgttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtccgctccaacgcggccctgggcgccatcttcacggacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggcgaagggcagccgcgccatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtctccaagaaggagggcggggcgatgtacgccgacgacaccgccgggtgggacacccgcatcacgctggaggacctcaagaacgaggagatggtgaccaaccacatgaagggcgagcacaagaagctggccgaggccatcttcaagctgacctaccagaacaaggtggtccgggtgcagcgcccgacgccccgggggacggtgatggacatcatcagccggaaggaccagcgcggctccggccaggtcgggacctacggcctcaacaccttcaccaacatggaggcgcagctgatccggcagatggagggggagggcatcttcaagagcatccagcgcctgacggtgaccgaggagatcgccgtgcagaactggctcgcccgggtcggccgcgagcggctgtcccgcatggccatcagcggggacgactgcgtggtgaagcccctggacgaccggttcgcctccgcgctcaccgccctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcccggatcagccagggcgccggctggtccctgaaggagacggcctgcctcggcaagagctacgcgcagatgtggaccctgatgtacttccaccgccgggacctgcgcctcgccgccaacgccatctgctccgccgtccccagccactgggtgcccacctcccggaccacctggagcatccacgcgaagcacgagtggatgacgaccgaggacatgctggccgtgtggaaccgcgtctggatccaggagaacccgtggatggaggacaagacccccgtggagtcctgggaggaggtgccctacctgggcaagcgcgaggaccagtggtgcgggagcctcatcggcctgaccagccgggccacgtgggccaagaacatccagaccgcgatcaaccaggtccgctccctgatcgggaacgaggagtacaccgactacatgcccagcatgaagcggttccgcaaggaggaggaggaggccggcgtgctctggtga

SEQ ID NO: 9421 - RNA, 9876 nt, synthetic construct
  misc_feature 1..9876: note = derived and/or modified CDS sequence (opt1) from DENV-2__EU687216__SS-prME
  source 1..9876: mol_type = other RNA
accgccggcgtgatcgtcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccggaccgagacctggatgagctccgagggggcctggaagcacgtgcagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtcgagggcgtgagcgggggctcctgggtggacatcgtcctcgagcacgggagctgcgtgaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaagatcgtgcagcccgagaacctggagtacaccatcgtgatcacgccccacagcggggaggagcacgccgtcggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcaccgacctggagaagcggcacgtcctcgggcgcctgatcaccgtgaacccgatcgtgacggagaaggacagccccgtcaacatcgaggcggagccgcccttcggcgactcctacatcatcgtgggggtggagccgggccagctgaagctcaactggttcaagaaggggagctccatcggccagatgttcgagaccaccatgcgcggcgccaagcggatggccatcctgggggacaccgcctgggacttcggcagcctcggcggggtcttcacgtccatcgggaaggccctccaccaggtgttcggggcgatctacggcgccgccttcagcggggtgtcctggaccatgaagatcctgatcggcgtcatcatcacctggatcgggatgaacagccgctccaccagcctgtccgtgagcctggtgctcgtcggcgtggtgacgctgtacctgggggccatggtccaggcggactccggctgcatcgtgagctggaagaacaaggagctcaagtgcggctccgggatcttcatcaccgacaacgtgcacacctggaccgagcagtacaagttccagcccgagagccccagcaagctggcctccgccatccagaaggcccacgaggagggcatctgcgggatccggagcgtcacgcgcctggagaacctcatgtggaagcagatcacccccgagctgaaccacatcctgtccgagaacgaggtgaagctcaccatcatgaccggcgacatcaaggggatcatgcaggccggcaagcggagcctgcgcccgcagcccacggagctgaagtactcctggaagacctggggcaaggcgaagatgctcagcaccgagtcccacaaccagaccttcctgatcgacgggcccgagacggccgagtgcccgaacaccaaccgggcctggaacagcctggaggtggaggactacggcttcggggtcttcaccaccaacatctggctcaagctgcgcgagaagcaggacgtgttctgcgactccaagctgatgagcgccgccatcaaggacaaccgggcggtgcacgccgacatgggctactggatcgagtccgccctcaacgacacctggaagatggagaaggccagcttcatcgaggtcaagtcctgccactggcccaagagccacacgctgtggtccaacggcgtgctggagagcgagatgatcatccccaagaacttcgccgggcccgtgtcccagcacaactaccgcccgggctaccacacccagaccgcggggccctggcacctcggcaagctggagatggacttcaacttctgcgaggggaccacggtcgtggtgaccgaggactgcggcaaccggggccccagcctgcgcaccaccacggccagcgggaagctcatcaccgagtggtgctgccggtcctgcaccctgcccccgctgcgctaccggggcgaggacgggtgctggtacggcatggagatccgccccctcaaggagaaggaggagaacctggtcaacagcctggtgaccgccgggcacggccagatcgacaacttctccctcggcgtgctggggatggccctgttcctcgaggagatgctgcggacgcgcgtcggcaccaagcacgcgatcctgctcgtggccctgagcttcgtgaccctgatcaccgggaacatgtccttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgagcaaggagctgatgatggccaccatcggcatcgccctcctgtcccagagcaccctgcccgagaccatcctcgagctgacggacgcgctggccctcgggatgatggtgctgaagatcgtccgcaacatggagaagtaccagctggccgtgaccatcatggccatctcctgcgtgccgaacgccgtcatcctccagaacgcgtggaaggtgagctgcaccatcctggccgccgtgtccgtcagccccctgctcctgacctccagccagcagaaggccgactggatccccctggcgctcacgatcaagggcctgaaccccaccgccatcttcctgaccaccctctcccggacgagcaagaagcgctcctggccgctgaacgaggccatcatggccgtgggcatggtcagcatcctggcctccagcctcctgaagaacgacatccccatgaccgggcccctggtggcgggcgggctcctgaccgtgtgctacgtcctgaccggccggagcgccgacctcgagctggagcgcgccgccgacgtgaagtgggaggaccaggccgagatctccgggagctcccccatcctgagcatcacgatctccgaggacggcagcatgtccatcaagaacgaggaggaggagcagaccctcaccatcctgatccggaccggcctgctcgtgatcagcggggtcttcccggtgtccatccccatcaccgcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcctgggctactcccagatcggcgccggggtctacaaggagggcacgttccacaccatgtggcacgtgacccgcggggccgtgctgatgcaccgcggcaagcggatcgagcccagctgggccgacgtcaagaaggacctcatctcctacgggggcggctggaagctggagggggagtggaaggagggcgaggaggtccaggtgctggccctcgagcccgggaagaacccccgcgcggtccagaccaagcccggcatcttcaagacgaacaccgggaccatcggcgccgtgagcctggacttctcccccggcaccagcgggtcccccatcgtggaccggaagggcaaggtcgtggggctgtacggcaacggcgtggtcacgcgcagcggggcctacgtgtccgccatcgcgcagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggccccgacccgcgtcgtggcggccgagatggaggaggccctgcgggggctccccatccgctaccagacccccgccatccgggccgagcacaccggccgcgagatcgtggacctgatgtgccacgcgacgttcaccatgcggctgctcagccccgtccgcgtgccgaactacaacctgatcatcatggacgaggcccacttcaccgaccccgcctccatcgccgcccggggctacatcagcacccgcgtggagatgggggaggcggccggcatcttcatgacggccacgccgcccgggtcccgggacccgttcccccagagcaacgcccccatcatggacgaggagcgcgagatccccgagcggtcctggaacagcggccacgagtgggtcaccgacttcaaggggaagaccgtgtggttcgtgccgtccatcaaggcgggcaacgacatcgccgcctgcctgcgcaagaacggcaagaaggtcatccagctcagccggaagacgttcgactccgagtacgtgaagacccgcgccaacgactgggacttcgtggtcaccaccgacatcagcgagatgggggccaacttcaaggcggagcgggtgatcgacccccgccggtgcatgaagcccgtgatcctgacggacggcgaggagcgcgtcatcctggccgggcccatgccggtgacccactccagcgccgcccagcggcgcggccgcatcgggcggaaccccaagaacgagaacgaccagtacatctacatgggcgagcccctcgagaacgacgaggactgcgcccactggaaggaggcgaagatgctgctggacaacatcaacacccccgagggcatcatcccgtccatgttcgagcccgagcgcgagaaggtggacgccatcgacggggagtaccggctccgcggcgaggcccggaagaccttcgtcgagctgatgcgccgcggggacctgcccgtgtggctcgcctacaaggtggccgcggagggcatcaactacgccgaccgcaagtggtgcttcgacgggatcaagaacaaccagatcctggaggagaacgtcgaggtggagatctggacgaaggagggcgagcggaagaagctgaagccgcgctggctcgacgcccggatctacagcgaccccctggccctgaaggagttcaaggagttcgcggccggccgcaagtccctcaccctgaacctgatcaccgagatggggcggctccccaccttcatgacgcagaaggcccgcaacgccctggacaacctggccgtgctccacaccgcggaggtcggcgggcgggcctacaaccacgccctgagcgagctgcccgagaccctcgagaccctgctgctcctgacgctgctcgccaccgtgaccggcggcatcttcctgttcctgatgtccgggaagggcgtcgggaagatgaccctcggcatgtgctgcatcatcaccgccagcatcctgctgtggtacgcgcagatccagccgcactggatcgccgcctccatcatcctcgagttcttcctgatcgtgctgctcatccccgagcccgagaagcagcgcacgccccaggacaaccagctgacctacgtggtcatcgccatcctgaccgtggtggccgcgaccatggccaacgagatggggttcctcgagaagacgaagaaggacctgggcttcggcagcatcaccacccaggagagcgagtccaacatcctggacatcgacctccggccggccagcgcctggaccctgtacgccgtcgcgacgaccttcatcacccccatgctgcgccactccatcgagaacagctccgtgaacgtgagcctcaccgccatcgccaaccaggccacggtcctgatggggctgggcaaggggtggcccctctccaagatggacatcggcgtgcccctgctggcgatcgggtgctacagccaggtgaacccgatcaccctcaccgccgccctgctgctcctggtcgcccactacgccatcatcggccccggcctgcaggcgaaggccacccgggaggcccagaagcgcgccgccgcggggatcatgaagaaccccacggtggacggcatcaccgtgatcgacctcgagcccatcccgtacgaccccaagttcgagaagcagctggggcaggtcatgctgctcatcctgtgcgtgacccaggtgctgatgatgcggaccacgtgggccctctgcgaggccctgaccctggccaccggccccatctccaccctctgggaggggaaccccggccgcttctggaacacgaccatcgccgtcagcatggcgaacatcttccgcggctcctacctggccggggccggcctcctgttcagcatcatgaagaacaccaccaacacgcggcgcgggaccggcaacgtgggcgagaccctgggggagaagtggaagtcccggctgaacgccctcggcaagagcgagttccagatctacaagaagtccgggatccaggaggtggaccgcaccctggcgaaggagggcatcaagcgcggggagacggaccaccacgccgtcagccgcggctccgccaagctgcggtggttcgtggagcgcaacatggtgaccccggagggcaaggtcgtggacctcgggtgcggccgcgggggctggagctactactgcgggggcctgaagaacgtgcgcgaggtcaagggcctgaccaagggcggccccgggcacgaggagcccatccccatgtccacctacggctggaacctcgtgcggctgcagagcggggtggacgtcttcttcacgccgcccgagaagtgcgacaccctgctctgcgacatcggcgagagctcccccaaccccaccatcgaggccggccgcaccctgcgggtgctgaacctcgtggagaactggctgaacaacaacacccagttctgcatcaaggtcctgaacccgtacatgcccagcgtgatcgagaagatggagacgctccagcgcaagtacgggggcgccctggtgcggaaccccctgtcccgcaacagcacccacgagatgtactgggtctccaacgcgaccgggaacatcgtgagctccgtgaacatgatcagccggatgctgatcaaccgcttcaccatgaagcacaagaaggccacgtacgagccggacgtcgacctcggctccgggacccggaacatcggcatcgagagcgagatccccaacctggacatcatcggcaagcgcatcgagaagatcaagcaggagcacgagacctcctggcactacgaccaggaccacccctacaagacctgggcctaccacgggagctacgagacgaagcagaccggctccgccagctccatggtgaacggggtggtccgcctgctcaccaagccctgggacgtggtgccgatggtcacccagatggccatgacggacaccacccccttcggccagcagcgggtgttcaaggagaaggtggacacccgcacgcaggagcccaaggagggcaccaagaagctgatgaagatcaccgcggagtggctgtggaaggagctcgggaaggagaagacgccccggatgtgcacgcgcgaggagttcacccggaaggtccgcagcaacgccgccctgggcgccatcttcaccgacgagaacaagtggaagtccgcccgggaggcggtggaggacgggcgcttctgggagctggtggaccgggagcgcaacctccacctggagggcaagtgcgagacctgcgtctacaacatgatggggaagcgggagaagaagctgggcgagttcggcaaggccaaggggagccgcgccatctggtacatgtggctcggcgcccggttcctggagttcgaggcgctggggttcctcaacgaggaccactggttctcccgcggcaacagcctgagcggggtggagggcgagggcctgcaccggctcgggtacatcctgcgcgaggtcggcaagaaggagggcggcgccatgtacgccgacgacacggccgggtgggacacccggatcaccctggaggacctcaagaacgaggagatggtgaccaaccacatgaagggcgagcacaagaagctggccgaggcgatcttcaagctgacgtaccagaacaaggtggtccgcgtgcagcggccgacgccccggggcaccgtgatggacatcatctcccggaaggaccagcgcgggagcggccaggtcgggacctacggcctcaacacgttcaccaacatggaggcccagctgatccgccagatggagggcgaggggatcttcaagtccatccagcacctgaccgccaccgaggagatcgccgtgcagaactggctcgcccgggtgggccgcgagcggctgagccgcatggcgatctccggggacgactgcgtcgtgaagcccatcgacgaccggttcgccagcgccctgacggccctcaacgacatgggcaaggtgcgcaaggacatccagcagtgggagccctcccgggggtggaacgactggacccaggtcccgttctgcagccaccacttccacgagctggtgatgaaggacggccgcgtgctggtcgtgccctgccggaaccaggacgagctcatcggccgcgcccggatctcccagggggcgggctggagcctgaaggagaccgcctgcctggggaagtcctacgcccagatgtggaccctcatgtacttccaccgccgggacctgcgcctggccgccaacgcgatctgcagcgccgtgccctcccactgggtccccaccagccggacgacctggtccatccacgccaagcacgagtggatgaccaccgaggacatgctcgccgtgtggaaccgcgtgtggatccaggagaacccgtggatggaggacaagacgcccgtcgagagctgggaggaggtgccctacctgggcaagcgggaggaccagtggtgcgggtccctgatcggcctcaccagccgcgcgacctgggccaagaacatccagaccgccatcaaccaggtgcggagcctgatcggcaacgaggagtacacggactacatgccctccatgaagcgcttccgccgggaggaggaggaggccggggtcctgtggtga

SEQ ID NO: 9422 - RNA, 9876 nt, synthetic construct
  misc_feature 1..9876: note = derived and/or modified CDS sequence (opt1) from DENV-2__EU726770__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctactcccagatcggcgcgggggtgtacaaggagggcaccttccacaccatgtggcacgtcacgcgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgccgtgcagaccaagcccggcctgttcaagaccaacaccgggacgatcggcgcggtcagcctcgacttctcccccggcaccagcgggtcccccatcgtggaccggaagggcaaggtggtcgggctgtacggcaacggcgtggtgacccgcagcggggcctacgtctccgccatcgcccagaccgagaagtccatcgaggacaaccccgagatcgaggacgacatcttccggaagaagcgcctgacgatcatggacctccaccccggcgcggggaagaccaagcggtacctgcccgccatcgtgcgcgaggccatcaagcggggcctgcgcaccctgatcctcgccccgacccgcgtggtcgccgcggagatggaggaggccctgcgggggctgcccatccgctaccagacgcccgccatccgggccgagcacaccggccgcgagatcgtggacctcatgtgccacgccaccttcaccatgcggctgctgagccccgtgcgcgtcccgaactacaacctcatcatcatggacgaggcgcacttcacggaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggccggcaacgacatcgcggcctgcctgcgcaagaacggcaagaaggtgatccagctgagccggaagaccttcgactccgagtacgtcaagacccgcgccaacgactgggacttcgtggtgacgaccgacatcagcgagatgggggccaacttccgggccgagcgcgtcatcgacccccggcgctgcatgaagcccgtgatcctcaccgacggcgaggagcgggtgatcctggcggggcccatgccggtcacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaaggcccgggacgccctcgacaacctggccgtgctgcacaccgccgaggtcggcgggcgcgcgtacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgacggtggtcgccgccaccatggcgaacgagatggggttcctggagaagaccaagaaggacctcggcctgggcagcatcaccacgcaggagagcgagtccaacatcctggacatcgacctccgcccggccagcgcctggaccctgtacgccgtggccaccaccttcgtgacgcccatgctgcggcactccatcgagaacagctccgtcaacgtgagcctcaccgcgatcgccaaccaggccaccgtgctgatggggctgggccgcgggtggcccctctccaagatggacatcggcgtccccctgctggccatcgggtgctacagccaggtgaacccgatcaccctcacggcggccctgctgctcctggtggcccactacgccatcatcggccccggcctgcaggccaaggcgacccgcgaggcccagaagcggaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgacgctggccaccggccccatctccaccctctgggaggggaaccccggccggttctggaacaccacgatcgccgtcagcatggccaacatcttccgcggctcctacctggccggggcgggcctcctcttcagcatcatgaagaacaccaccaacacccggcgcgggacgggcaacatcggcgagaccctgggggagaagtggaagtcccggctgaacgccctcggcaagagcgagttccagatctacaagaagtccgggatccaggaggtggaccgcaccctggccaaggagggcatcaagcgcggggagaccgaccaccacgccgtgagccgcggctccgcgaagctgcggtggttcgtcgagcgcaacatggtgacgccggagggcaaggtggtcgacctcgggtgcggccgcggcgggtggagctactactgcggcgggctgaagaacgtgcgcgaggtgaaggggctgaccaagggcgggcccgggcacgaggagcccatccccatgtccacctacggctggaacctcgtccggctgcagagcggggtggacgtgttcttcaccccgcccgagaagtgcgacacgctgctctgcgacatcggcgagagctcccccaaccccaccatcgaggccggccgcaccctgcgggtcctgaacctcgtggagaactggctgaacaacaacacccagttctgcgtgaaggtcctgaacccgtacatgcccagcgtgatcgagaagatggagaccctccagcgcaagtacgggggcgccctggtgcggaaccccctgtcccgcaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctcggctccgggacgcgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagaccaagcagacgggcagcgcctccagcatggtgaacggggtggtcaagctgctcaccaagccctgggacgtggtgccgatggtcacccagatggccatgaccgacacgacccccttcggccagcagcgcgtgttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtccgctccaacgccgcgctgggcgccatcttcaccgacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtctccaagaaggagggcgggaccatgtacgccgacgacacggcggggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccgggggaccgtgatggacatcatcagccggaaggaccagcgcggctccggccaggtcgggacctacggcctcaacacgttcaccaacatggaggcccagctgatccggcagatggagggggagggcatcttcaagagcatccagcgcctgaccgtgaccgaggagatcgccgtgcagaactggctcgcgcgggtcggccgcgagcggctgtcccgcatggccatcagcggggacgactgcgtggtgaagcccctggacgaccggttcgcctccgccctcacggccctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcgcggatcagccagggcgccggctggtccctgaaggagaccgcctgcctcggcaagagctacgcccagatgtggaccctgatgtacttccaccgccgggacctgcgcctcgccgcgaacgccatctgctccgccgtccccagccactgggtgcccacctcccggacgacctggagcatccacgccaagcacgagtggatgaccaccgaggacatgctggccgtgtggaaccgcgtctggatccaggagaacccgtggatggaggacaagacgcccgtggagtcctgggaggaggtgccctacctgggcaagcgcgaggaccagtggtgcgggagcctcatcggcctgaccagccgggcgacctgggccaagaacatccagaccgccatcaaccaggtccgctccctgatcgggaacgaggagtacacggactacatgcccagcatgaagcggttccgcaaggaggaggaggaggccggcgtgctctggtga

SEQ ID NO: 9423 - RNA, 9876 nt, synthetic construct
  misc_feature 1..9876: note = derived and/or modified CDS sequence (opt1) from DENV-2__EU781135__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccatcatggccgtcggcatggtgagcatcctggcctccagcctgctcaagaacgacatccccatgaccgggcccctggtggccggcgggctgctcacggtctgctacgtgctgaccggccggagcgcggacctggagctcgagcgcgccgccgacgtgaagtgggaggaccaggccgagatctccgggagctcccccatcctgagcatcaccatctccgaggacggcagcatgtccatcaagaacgaggaggaggagcacaccctgacgatcctcatccggaccggcctgctggtcatcagcggggtgttcccggtgtccatccccatcaccgccgcggcctggtacctctgggaggtcaagaagcagcgcgccggcgtgctgtgggacgtgcccagcccgccgcccgtcgggaaggccgagctggaggacggcgcctaccggatcaagcagcgcgggatcttcggctactcccagatcggcgcgggggtgtacaaggagggcaccttccacaccatgtggcacgtgacgcgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgccctggagcccgggaagaacccccgcgccgtgcagaccaagcccggcctgttcaagaccaacaccgggacgatcggcgcggtgagcctcgacttctcccccggcaccagcgggtcccccatcgtcgaccggaagggcaaggtggtggggctgtacggcaacggcgtcgtgacccgcagcggggcctacgtgtccgccatcgcccagaccgagaagtccatcgaggacaaccccgagatcgaggacgacatcttccggaagaagcgcctgacgatcatggacctccaccccggcgcggggaagaccaagcggtacctgcccgccatcgtccgcgaggccatcaagcggggcctgcgcaccctgatcctcgccccgacccgcgtggtggccgcggagatggaggaggccctgcgggggctgcccatccgctaccagacgcccgccatccgggccgagcacaccggccgcgagatcgtcgacctcatgtgccacgccaccttcaccatgcggctgctgagccccgtgcgcgtgccgaactacaacctcatcatcatggacgaggcgcacttcacggaccccgcctccatcgccgcccggggctacatcagcacccgcgtcgagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtgtggttcgtcccgtccatcaaggccggcaacgacatcgcggcctgcctgcgcaagaacggcaagaaggtgatccagctgagccggaagaccttcgactccgagtacgtgaagacccgcgccaacgactgggacttcgtcgtgacgaccgacatcagcgagatgggggccaacttccgggccgagcgcgtgatcgacccccggcgctgcatgaagcccgtcatcctcaccgacggcgaggagcgggtgatcctggcggggcccatgccggtgacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtcgacgcgatcgacggggagtaccgcctgcggggcgaggcccgcaagaccttcgtggacctcatgcggcgcggggacctgcccgtgtggctggcctaccgggtcgccgccgagggcatcaactacgcggaccgccggtggtgcttcgacgggatcaagaacaaccagatcctcgaggagaacgtggaggtggagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaaggcccgggacgccctcgacaacctggccgtcctgcacaccgccgaggtgggcgggcgcgcgtacaaccacgccctcagcgagctgcccgagacgctggagaccctcctgctgctcaccctgctggccaccgtcacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtggtcatcgccatcctgacggtggtggccgccaccatggcgaacgagatggggttcctggagaagaccaagaaggacctcggcctgggcagcatcaccacgcaggagagcgagtccaacatcctggacatcgacctccgcccggccagcgcctggaccctgtacgccgtcgccaccaccttcgtgacgcccatgctgcggcactccatcgagaacagctccgtgaacgtcagcctcaccgcgatcgccaaccaggccaccgtgctgatggggctgggccgcgggtggcccctctccaagatggacatcggcgtgcccctgctggccatcgggtgctacagccaggtcaacccgatcaccctcacggcggccctgctgctcctggtggcccactacgccatcatcggccccggcctgcaggccaaggcgacccgcgaggcccagaagcggaccgccgccgggatcatgaagaaccccaccgtggacggcatcacggtcatcgacctcgagcccatcccgtacgaccccaagttcgagaagcagctgggccaggtgatgctgctcgtgctgtgcgtcacccaggtgctgatgatgcgcaccacctgggccctctgcgaggcgctgacgctggccaccggccccatctccaccctctgggaggggaaccccggccggttctggaacaccacgatcgccgtgagcatggccaacatcttccgcggctcctacctggccggggcgggcctcctcttcagcatcatgaagaacaccaccaacacccggcgcgggacgggcaacatcggcgagaccctgggggagaagtggaagtcccggctgaacgccctcggcaagagcgagttccagatctacaagaagtccgggatccaggaggtcgaccgcaccctggccaaggagggcatcaagcgcggggagaccgaccaccacgccgtgagccgcggctccgcgaagctgcggtggttcgtggagcgcaacatggtcacgccggagggcaaggtggtggacctcgggtgcggccgcggcgggtggagctactactgcggcgggctgaagaacgtccgcgaggtgaaggggctgaccaagggcgggcccgggcacgaggagcccatccccatgtccacctacggctggaacctcgtgcggctgcagagcggggtcgacgtgttcttcaccccgcccgagaagtgcgacacgctgctctgcgacatcggcgagagctcccccaaccccaccatcgaggccggccgcaccctgcgggtgctgaacctcgtcgagaactggctgaacaacaacacccagttctgcgtgaaggtgctgaacccgtacatgcccagcgtcatcgagaagatggagaccctccagcgcaagtacgggggcgccctggtgcggaaccccctgtcccgcaacagcacgcacgagatgtactgggtgtccaacgccaccgggaacatcgtcagctccgtgaacatgatcagccgcatgctgatcaaccggttcaccatgaagcacaagaaggccacctacgagccggacgtggacctcggctccgggacgcgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagaccaagcagacgggcagcgcctccagcatggtcaacggggtggtgaagctgctcaccaagccctgggacgtcgtgccgatggtgacccagatggccatgaccgacacgacccccttcggccagcagcgcgtcttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtgcgctccaacgccgcgctgggcgccatcttcaccgacgagaacaagtggaagtccgcccgggaggccgtcgaggactcccgcttctgggagctggtggaccgggagcgcaacctccacctggaggggaagtgcgagacctgcgtctacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtgtccaagaaggagggcggggccatgtacgcggacgacaccgccgggtgggacacgcgcatcaccctggaggacctcaagaacgaggagatggtcaccaaccacatgaagggcgagcacaagaagctggccgaggccatcttcaagctgacctaccagaacaaggtggtgcgggtccagcgcccgacgccccgcgggaccgtgatggacatcatcagccggaaggaccagcgcggctccggccaggtggggacctacggcctcaacaccttcacgaacatggaggcccagctgatccggcagatggagggggagggcatcttcaagagcatccagcgcctgaccgtcaccgaggagatcgcggtgcagaactggctcgcccgggtgggccgcgagcggctgtcccgcatggccatcagcggggacgactgcgtcgtgaagcccctggacgaccggttcgcctccgccctcaccgcgctgaacgacatgggcaaggtgcgcaaggacatccagcagtgggagcccagccgggggtggaacgactggacgcaggtcccgttctgctcccaccacttccacgagctggtgatgaaggacggccgcgtgctcgtcgtgccctgccggaaccaggacgagctgatcgggcgcgcccggatcagccagggcgccggctggtccctgaaggagaccgcctgcctcggcaagagctacgcccagatgtggaccctgatgtacttccaccgccgggacctgcgcctcgcggccaacgccatctgctccgccgtgcccagccactgggtccccacctcccggaccacgtggagcatccacgccaagcacgagtggatgaccaccgaggacatgctggcggtgtggaaccgcgtgtggatccaggagaacccgtggatggaggacaagacccccgtcgagtcctgggaggaggtgccctacctgggcaagcgcgaggaccagtggtgcgggagcctcatcggcctgacgagccgggccacctgggccaagaacatccagaccgccatcaaccaggtgcgctccctgatcgggaacgaggagtacaccgactacatgcccagcatgaagcggttccgcaaggaggaggaggaggcgggcgtcctctggtga

SEQ ID NO: 9424 - RNA, 9876 nt, synthetic construct
  misc_feature 1..9876: note = derived and/or modified CDS sequence (opt1) from DENV-2__EU687222__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgacggccgggcacggccagatcgacaacttcagcctgggcgtgctggggatggccctcttcctggaggagatgctgcggacccgcgtcggcaccaagcacgccatcctcctggtggcggtgtccttcgtcaccctgatcacggggaacatgagcttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtcatggccgtgggcatggtgtccatcctggccagcagcctgctcaagaacgacatccccatgaccgggcccctggtcgccggcgggctgctcaccgtgtgctacgtgctgacgggccggtccgcggacctggagctcgagcgcgccgccgacgtcaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtgttcccggtcagcatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacaccatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgcggtctccctcgacttcagccccggcacgtccgggagccccatcgtggaccggaagggcaaggtggtcgggctgtacggcaacggcgtggtgacccgctccggggcctacgtcagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtggtcgccgcggagatggaggaggccctgcgggggctgcccatccgctaccagacccccgccatccgggccgagcacacgggccgcgagatcgtggacctcatgtgccacgccaccttcaccatgcggctgctgtcccccgtgcgcgtcccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggccggcaacgacatcgcggcctgcctgcgcaagaacggcaagaaggtgatccagctgtcccggaagaccttcgacagcgagtacgtcaagacccgcgccaacgactgggacttcgtggtgaccacggacatctccgagatgggggccaacttccgggccgagcgcgtcatcgacccccggcgctgcatgaagcccgtgatcctcaccgacggcgaggagcgggtgatcctggcggggcccatgccggtcacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggtcggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtgacccccatgctgcggcacagcatcgagaactccagcgtcaacgtgtccctcacggcgatcgccaaccaggccaccgtgctgatggggctgggccgcgggtggcccctcagcaagatggacatcggcgtccccctgctggccatcgggtgctactcccaggtgaacccgatcaccctcaccgcggccctgctgctcctggtggcccactacgccatcatcggccccggcctgcaggccaaggcgacgcgcgaggcccagaagcggaccgccgccgggatcatgaagaaccccaccgtcgacggcatcaccgtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgaccctggccacgggccccatcagcaccctctgggaggggaaccccggccggttctggaacaccaccatcgccgtctccatggccaacatcttccgcggcagctacctggccggggcgggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgcgaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgacgaagggcgggcccgggcacgaggagcccatccccatgagcacctacggctggaacctcgtccggctgcagagcggggtggacgtgttcttcaccccgcccgagaagtgcgacaccctgctctgcgacatcggcgagtccagccccaaccccacgatcgaggccggccgcaccctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccacggggaacatcgtctccagcgtgaacatgatctcccgcatgctgatcaaccggttcaccatgaagcacaagaaggccacctacgagccggacgtggacctcggcagcgggacccgcaacatcggcatcgagaacgagatccccaacctggacatcatcggcaagcggatcgagaagatcaagcaggagcacgagacgtcctggcactacgaccaggaccacccctacaagacctgggcgtaccacgggagctacgagaccaagcagaccggctccgccagctccatggtcaacggggtggtgaagctgctcacgaagccctgggacgtcgtgccgatggtgacccagatggccatgaccgacaccacgcccttcggccagcagcgcgtcttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtgcgcagcaacgccgcgctgggcgccatcttcacggacgagaacaagtggaagtccgcccgggaggccgtcgaggacagccgcttctgggagctggtggaccgggagcgcaacctccacctggaggggaagtgcgagacctgcgtctacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtgagcaagaaggagggcggggccatgtacgcggacgacaccgccgggtgggacacccgcatcacgctggaggacctcaagaacgaggagatggtcaccaaccacatgaagggcgagcacaagaagctggccgaggccatcttcaagctgacctaccagaacaaggtggtgcgggtccagcgcccgacgccccgggggacggtgatggacatcatctcccggaaggaccagcgcggcagcggccaggtggggacctacggcctcaacaccttcaccaacatggaggcccagctgatccggcagatggagggggagggcatcttcaagtccatccagcgcctgacggtcaccgaggagatcgcggtgcagaactggctcgcccgggtgggccgcgagcggctgagccgcatggccatctccggggacgactgcgtcgtgaagcccctggacgaccggttcgccagcgccctcaccgcgctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcgggcgcgcccggatctcccagggcgccggctggagcctgaaggagacggcctgcctcgggaagtcctacgcccagatgtggaccctgatgtacttccaccgccgggacctgcgcctcgcggccaacgccatctgcagcgccgtgccctcccactgggtccccaccagccggaccacctggtccatccacgccaagcacgagtggatgacgaccgaggacatgctggcggtgtggaaccgcgtgtggatccaggagaacccgtggatggaggacaagacccccgtcgagagctgggaggaggtgccctacctgggcaagcgcgaggaccagtggtgcgggagcctcatcggcctgacctcccgggccacgtgggccaagaacatccagaccgccatcaaccaggtgcgcagcctgatcgggaacgaggagtacaccgactacatgccctccatgaagcggttccgcaaggaggaggaggaggcgggcgtcctctggtga

SEQ ID NO: 9425 - RNA, 9876 nt, synthetic construct
  misc_feature 1..9876: note = derived and/or modified CDS sequence (opt1) from DENV-2__EU687223__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccggcaaggacagccccgtcaacatcgaggcggagccgcccttcggggactcctacatcatcatcggcgtggagccggggcagctcaagctgaactggttcaagaagggcagctccatcggccagatgttcgagaccacgatgcgcggggccaagcggatggccatcctgggcgacaccgcctgggacttcgggagcctcggcggggtgttcacctccatcggcaaggccctgcaccaggtcttcggcgcgatctacggggccgccttcagcggcgtgtcctggaccatgaagatcctgatcggggtgatcatcacgtggatcggcatgaacagccgctccaccagcctgtccgtcagcctcgtgctggtgggggtcgtgaccctgtacctcggcgtgatggtccaggccgactccggctgcgtggtgagctggaagaacaaggagctgaagtgcgggtccggcatcttcatcaccgacaacgtccacacgtggaccgagcagtacaagttccagcccgagagccccagcaagctggcgtccgccatccagaaggcccacgaggaggggatctgcggcatccggagcgtgacccgcctcgagaacctgatgtggaagcagatcacccccgagctgaaccacatcctctccgagaacgaggtgaagctgacgatcatgaccggggacatcaagggcatcatgcaggccggcaagcggagcctgcgcccgcagcccaccgagctcaagtactcctggaagacctgggggaaggccaagatgctgagcacggagtcccacaaccagaccttcctgatcgacggccccgagaccgcggagtgcccgaacaccaaccgggcctggaacagcctcgaggtcgaggactacgggttcggcgtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggggtgctcgagtccgagatgatcatccccaagaacttcgccggccccgtgagccagcacaactaccgcccggggtaccacacccagaccgccggcccctggcacctggggaagctggagatggacttcgacttctgcgagggcacgaccgtcgtggtgaccgaggactgcggcaaccgggggcccagcctccgcaccacgaccgcgtccggcaagctgatcaccgagtggtgctgccggagctgcaccctgcccccgctccgctaccgcggggaggacggctgctggtacgggatggagatccgccccctgaaggagaaggaggagaacctggtcaactccctcgtgacggccggccacggccagatcgacaacttcagcctgggggtgctgggcatggccctcttcctggaggagatgctgcggacccgcgtcgggaccaagcacgccatcctcctggtggcggtgtccttcgtcaccctgatcacgggcaacatgagcttccgggacctcgggcgcgtgatggtgatggtcggcgccaccatgaccgacgacatcggcatgggggtgacctacctggccctgctcgccgccttcaaggtgcgccccacgttcgcggccggcctgctgctccggaagctgacctccaaggagctgatgatggccaccatcgggatcgccctcctgagccagtccaccatccccgagacgatcctggagctcaccgacgccctggcgctgggcatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtcatggccgtggggatggtgtccatcctggccagcagcctgctcaagaacgacatccccatgaccggccccctggtcgccgggggcctgctcaccgtgtgctacgtgctgacggggcggtccgcggacctggagctcgagcgcgccgccgacgtcaagtgggaggaccaggccgagatcagcggctccagccccatcctgtccatcaccatcagcgaggacggctccatgagcatcaagaacgaggaggaggagcacaccctgaccatcctcatccggacggggctgctggtgatctccggcgccttcccggtgagcatccccatcaccgcggccgcctggtacctctgggaggtcaagaagcagcgcgccggggtgctgtgggacgtgcccagcccgccgcccgtcggcaaggccgagctggaggacggggcgtaccggatcaagcagcgcggcatcttcggctacagccagatcggggccggcgtgtacaaggaggggaccttccacaccatgtggcacgtgacccggggcgccgtcctcatgcaccgcgggaagcggatcgagccctcctgggccgacgtgaagaaggacctgatcagctacggcggcgggtggaagctggagggcgagtggaaggagggggaggaggtgcaggtcctcgccctggagcccggcaagaacccccgcgcggtgcagacgaagcccgggctgttcaagaccaacaccggcaccatcggcgccgtgtccctcgacttcagccccgggacgtccggcagccccatcgtcgaccggaaggggaaggtggtgggcctgtacggcaacggggtcgtgacccgctccggcgcctacgtgagcgccatcgcgcagaccgagaagtccatcgaggacaaccccgagatcgaggacgacatcttccggaagaagcgcctgaccatcatggacctccaccccggggccggcaagacgaagcggtacctgcccgccatcgtccgcgaggccatcaagcgggggctgcgcaccctgatcctcgccccgacccgcgtggtggcggccgagatggaggaggccctgcggggcctgcccatccgctaccagacccccgccatccgggccgagcacacgggccgcgagatcgtcgacctcatgtgccacgcgaccttcaccatgcggctgctgtcccccgtgcgcgtgccgaactacaacctcatcatcatggacgaggcccacttcaccgaccccgccagcatcgccgcccgggggtacatctccacgcgcgtcgagatgggcgaggcggccgggatcttcatgaccgccacgccgcccggcagccgggacccgttcccccagtccaacgcccccatcatggacgaggagcgcgagatccccgagcggagctggaactccgggcacgagtgggtgaccgacttcaagggcaagacggtgtggttcgtcccgagcatcaaggcgggcaacgacatcgccgcctgcctgcgcaagaacgggaagaaggtgatccagctgtcccggaagaccttcgacagcgagtacgtgaagacccgcgccaacgactgggacttcgtcgtgaccacggacatctccgagatgggcgccaacttccgggcggagcgcgtgatcgacccccggcgctgcatgaagcccgtcatcctcaccgacggggaggagcgggtgatcctggccggccccatgccggtgacccacagctccgccgcccagcgccgcgggcggatcggccgcaaccccaagaacgagaacgaccagtacatctacatgggcgagcccctggagaacgacgaggactgcgcccactggaaggaggcgaagatgctcctggacaacatcaacacccccgaggggatcatcccgagcatgttcgagcccgagcgggagaaggtcgacgccatcgacggcgagtaccgcctgcgcggggaggcccgcaagacgttcgtggacctcatgcggcgcggcgacctgcccgtgtggctggcctaccgggtcgccgcggaggggatcaactacgccgaccgccggtggtgcttcgacggcatcaagaacaaccagatcctcgaggagaacgtggaggtggagatctggaccaaggagggcgagcgcaagaagctgaagccgcggtggctggacgcccgcatctactccgaccccctcgccctgaaggagttcaaggagttcgcggccgggcggaagtccctgaccctcaacctgatcaccgagatgggccgcctgcccacgttcatgacccagaaggcccgggacgccctcgacaacctggccgtcctgcacaccgcggaggtcgggggccgcgcctacaaccacgccctctccgagctgcccgagaccctggagacgctcctgctgctcaccctgctggccaccgtcaccggcgggatcttcctcttcctgatgagcggcaaggggatcggcaagatgacgctggggatgtgctgcatcatcaccgcctccatcctcctgtggtacgcgcagatccagccgcactggatcgccgccagcatcatcctggagttcttcctcatcgtgctgctgatccccgagcccgagaagcagcggacgccccaggacaaccagctcacctacgtggtcatcgccatcctgaccgtggtggccgcgacgatggccaacgagatgggcttcctggagaagaccaagaaggacctcggcctggggagcatcaccacccaggagtccgagagcaacatcctggacatcgacctccgcccggcctccgcctggacgctgtacgccgtcgcgaccaccttcgtgacccccatgctgcggcacagcatcgagaactccagcgtgaacgtctccctcacggccatcgccaaccaggccaccgtgctgatgggcctggggcgcggctggcccctcagcaagatggacatcggggtgcccctgctggcgatcggctgctactcccaggtcaacccgatcaccctcaccgccgccctgctgctcctggtggcccactacgccatcatcggccccgggctgcaggcgaaggccacgcgcgaggcccagaagcggaccgccgccggcatcatgaagaaccccaccgtggacgggatcaccgtcatcgacctcgagcccatcccgtacgaccccaagttcgagaagcagctgggccaggtgatgctgctcgtgctgtgcgtcacccaggtgctgatgatgcgcaccacctgggcgctctgcgaggccctgaccctggccacggggcccatcagcaccctctgggagggcaaccccggccggttctggaacaccaccatcgccgtgtccatggccaacatcttccgcgggagctacctggcgggcgccgggctcctcttctccatcatgaagaacacgaccaacacccggcgcggcaccggcaacatcggggagacgctgggcgagaagtggaagtcccggctgaacgccctcgggaagtccgagttccagatctacaagaagtccggcatccaggaggtcgaccgcaccctggccaaggaggggatcaagcggggcgagaccgaccaccacgcggtgtcccgcggcagcgccaagctgcggtggttcgtggagcgcaacatggtcaccccggaggggaaggtggtggacctcggctgcgggcggggcgggtggtcctactactgcggcggcctgaagaacgtccgcgaggtgaaggggctgacgaagggcgggcccggccacgaggagcccatccccatgagcacctacgggtggaacctcgtgcggctgcagagcggcgtcgacgtgttcttcaccccgcccgagaagtgcgacaccctgctctgcgacatcggcgagtccagccccaaccccacgatcgaggccgggcgcaccctgcgggtgctgaacctcgtcgagaactggctgaacaacaacacccagttctgcatcaaggtgctgaacccgtacatgccctccgtgatcgagaagatggagaccctccagcgcaagtacggcggggccctggtccggaaccccctgagccgcaactccacccacgagatgtactgggtgagcaacgccacgggcaacatcgtgtccagcgtcaacatgatctcccgcatgctgatcaaccggttcaccatgaagcacaagaaggcgacctacgagccggacgtggacctcgggagcggcacccgcaacatcggcatcgagaacgagatccccaacctggacatcatcgggaagcggatcgagaagatcaagcaggagcacgagacgtcctggcactacgaccaggaccacccctacaagacctgggcctaccacggcagctacgagaccaagcagaccgggtccgccagctccatggtgaacggcgtcgtgaagctgctcacgaagccctgggacgtggtcccgatggtgacccagatggccatgaccgacaccacgcccttcggccagcagcgcgtgttcaaggagaaggtcgacacccggacccaggagcccaaggaggggaccaagaagctgatgcgcatcacggccgagtggctgtggaaggagctcggcaagaagaagacgccccggatgtgcacccgcgaggagttcacccggaaggtgcgcagcaacgcggccctgggggccatcttcacggacgagaacaagtggaagtccgcccgggaggccgtggaggacagccgcttctgggagctggtcgaccgggagcgcaacctccacctggagggcaagtgcgagacctgcgtgtacaacatgatggggaagcgggagaagaagctgggcgagttcggcaaggcgaaggggtcccgcgccatctggtacatgtggctcggcgcccggttcctggagttcgaggccctggggttcctcaacgaggaccactggttcagccgcggcaacagcctgtccggggtcgagggcgagggcctgcacaagctcgggtacatcctgcgggacgtgagcaagaaggagggcggggcgatgtacgccgacgacaccgccggctgggacacccgcatcacgctggaggacctcaagaacgaggagatggtgaccaaccacatgaagggggagcacaagaagctggccgaggccatcttcaagctgacctaccagaacaaggtcgtgcgggtgcagcgcccgacgccccggggcacggtcatggacatcatctcccggaaggaccagcgcggcagcggccaggtggggacctacgggctcaacaccttcaccaacatggaggcgcagctgatccggcagatggagggcgagggcatcttcaagtccatccagcgcctgacggtgaccgaggagatcgccgtccagaactggctcgcccgggtggggcgcgagcggctgagccgcatggccatctccggcgacgactgcgtggtcaagcccctggacgaccggttcgccagcgcgctcaccgccctgaacgacatggggaaggtgcgcaaggacatccagcagtgggagccctcccggggctggaacgactggacccaggtgccgttctgcagccaccacttccacgagctggtcatgaaggacgggcgcgtgctcgtggtcccctgccggaaccaggacgagctgatcggccgcgcccggatctcccagggcgccgggtggagcctgaaggagacggcctgcctcggcaagtcctacgcgcagatgtggaccctgatgtacttccaccgccgggacctgcgcctcgccgccaacgccatctgcagcgccgtgccctcccactgggtgcccaccagccggaccacctggtccatccacgcgaagcacgagtggatgacgaccgaggacatgctggccgtctggaaccgcgtgtggatccaggagaacccgtggatggaggacaagacccccgtggagagctgggaggaggtcccctacctggggaagcgcgaggaccagtggtgcggcagcctcatcgggctgacctcccgggccacgtgggccaagaacatccagaccgcgatcaaccaggtgcgcagcctgatcggcaacgaggagtacaccgactacatgccctccatgaagcggttccgcaaggaggaggaggaggccggcgtgctctggtga

SEQ ID NO: 9426 - RNA, 9876 nt, synthetic construct
  misc_feature 1..9876: note = derived and/or modified CDS sequence (opt1) from DENV-2__EU687227__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgacggccgggcacggccagatcgacaacttcagcctgggcgtgctggggatggccctcttcctggaggagatgctgcggacccgcgtcggcaccaagcacgccatcctcctggtggcggtgtccttcgtcaccctgatcacggggaacatgagcttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtcatggccgtgggcatggtgtccatcctggccagcagcctgctcaagaacgacatccccatgaccgggcccctggtcgccggcgggctgctcaccgtgtgctacgtgctgacgggccggtccgcggacctggagctcgagcgcgccgccgacgtcaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtgttcccggtcagcatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacaccatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgcggtctccctcgacttcagccccggcacgtccgggagccccatcgtggaccggaagggcaaggtggtcgggctgtacggcaacggcgtggtgacccgctccggggcctacgtcagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtggtcgccgcggagatggaggaggccctgcgggggctgcccatccgctaccagacccccgccatccgggccgagcacacgggccgcgagatcgtggacctcatgtgccacgccaccttcaccatgcggctgctgtcccccgtgcgcgtcccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggccggcaacgacatcgcggcctgcctgcgcaagaacggcaagaaggtgatccagctgtcccggaagaccttcgacagcgagtacgtcaagacccgcgccaacgactgggacttcgtggtgaccacggacatctccgagatgggggccaacttccgggccgagcgcgtcatcgacccccggcgctgcatgaagcccgtgatcctcaccgacggcgaggagcgggtgatcctggcggggcccatgccggtcacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggtcggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtgacccccatgctgcggcacagcatcgagaactccagcgtcaacgtgtccctcacggcgatcgccaaccaggccaccgtgctgatggggctgggccgcgggtggcccctcagcaagatggacatcggcgtccccctgctggccatcgggtgctactcccaggtgaacccgatcaccctcaccgcggccctgctgctcctggtggcccactacgccatcatcggccccggcctgcaggccaaggcgacgcgcgaggcccagaagcggaccgccgccgggatcatgaagaaccccaccgtcgacggcatcaccgtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgaccctggccacgggccccatcagcaccctctgggaggggaaccccggccggttctggaacaccaccatcgccgtctccatggccaacatcttccgcggcagctacctggccggggcgggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgcgaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgacgaagggcgggcccgggcacgaggagcccatccccatgagcacctacggctggaacctcgtccggctgcagagcggggtggacgtgttcttcaccccgcccgagaagtgcgacaccctgctctgcgacatcggcgagtccagccccaaccccacgatcgaggccggccgcaccctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccacggggaacatcgtctccagcgtgaacatgatctcccgcatgctgatcaaccggttcaccatgaagcacaagaaggccacctacgagccggacgtggacctcggcagcgggacccgcaacatcggcatcgagaacgagatccccaacctggacatcatcggcaagcggatcgagaagatcaagcaggagcacgagacgtcctggcactacgaccaggaccacccctacaagacctgggcgtaccacgggagctacgagaccaagcagaccggctccgccagctccatggtcaacggggtggtgaagctgctcacgaagccctgggacgtcgtgccgatggtgacccagatggccatgaccgacaccacgcccttcggccagcagcgcgtcttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtgcgcagcaacgccgcgctgggcgccatcttcacggacgagaacaagtggaagtccgcccgggaggccgtcgaggacagccgcttctgggagctggtggaccgggagcgcaacctccacctggaggggaagtgcgagacctgcgtctacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtgagcaagaaggagggcggggccatgtacgcggacgacaccgccgggtgggacacccgcatcacgctggaggacctcaagaacgaggagatggtcaccaaccagatgaagggcgagcacaagaagctggccgaggccatcttcaagctgacctaccagaacaaggtggtgcgggtccagcgcccgacgccccgggggacggtgatggacatcatctcccggaaggaccagcgcggcagcggccaggtggggacctacggcctcaacaccttcaccaacatggaggcccagctgatccggcagatggagggggagggcatcttcaagtccatccagcgcctgacggtcaccgaggagatcgcggtgcagaactggctcgcccgggtgggccgcgagcggctgagccgcatggccatctccggggacgactgcgtcgtgaagcccctggacgaccggttcgccagcgccctcaccgcgctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcgggcgcgcccggatctcccagggcgccggctggagcctgaaggagacggcctgcctcgggaagtcctacgcccagatgtggaccctgatgtacttccaccgccgggacctgcgcctcgcggccaacgccatctgcagcgccgtgccctcccactgggtccccaccagccggaccacctggtccatccacgccaagcacgagtggatgacgaccgaggacatgctggcggtgtggaaccgcgtgtggatccaggagaacccgtggatggaggacaagacccccgtcgagagctgggaggaggtgccctacctgggcaagcgcgaggaccagtggtgcgggagcctcatcggcctgacctcccgggccacgtgggccaagaacatccagaccgccatcaaccaggtgcgcagcctgatcgggaacgaggagtacaccgactacatgccctccatgaagcggttccgcaaggaggaggaggaggcgggcgtcctctggtga

SEQ ID NO: 9427 - RNA, 9876 nt, synthetic construct
  misc_feature 1..9876: note = derived and/or modified CDS sequence (opt1) from DENV-2__EU687228__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaacgagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgacggccgggcacggccagatcgacaacttcagcctgggcgtgctggggatggccctcttcctggaggagatgctgcggacccgcgtcggcaccaagcacgccatcctcctggtggcggtgtccttcgtcaccctgatcacggggaacatgagcttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtcatggccgtgggcatggtgtccatcctggccagcagcctgctcaagaacgacatccccatgaccgggcccctggtcgccggcgggctgctcaccgtgtgctacgtgctgacgggccggtccgcggacctggagctcgagcgcgccgccgacgtcaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtgttcccggtcagcatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacaccatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgcggtctccctcgacttcagccccggcacgtccgggagccccatcgtggaccggaagggcaaggtggtcgggctgtacggcaacggcgtggtgacccgctccggggcctacgtcagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtggtcgccgcggagatggaggaggccctgcgggggctgcccatccgctaccagacccccgccatccgggccgagcacacgggccgcgagatcgtggacctcatgtgccacgccaccttcaccatgcggctgctgtcccccgtgcgcgtcccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggccggcaacgacatcgcggcctgcctgcgcaagaacggcaagaaggtgatccagctgtcccggaagaccttcgacagcgagtacgtcaagacccgcgccaacgactgggacttcgtggtgaccacggacatctccgagatgggggccaacttccgggccgagcgcgtcatcgacccccggcgctgcatgaagcccgtgatcctcaccgacggcgaggagcgggtgatcctggcggggcccatgccggtcacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggtcggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtgacccccatgctgcggcacagcatcgagaactccagcgtcaacgtgtccctcacggcgatcgccaaccaggccaccgtgctgatggggctgggccgcgggtggcccctcagcaagatggacatcggcgtccccctgctggccatcgggtgctactcccaggtgaacccgatcaccctcaccgcggccctgctgctcctggtggcccactacgccatcatcggccccggcctgcaggccaaggcgacgcgcgaggcccagaagcggaccgccgccgggatcatgaagaaccccaccgtcgacggcatcaccgtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgaccctggccacgggccccatcagcaccctctgggaggggaaccccggccggttctggaacaccaccatcgccgtctccatggccaacatcttccgcggcagctacctggccggggcgggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgcgaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgacgaagggcgggcccgggcacgaggagcccatccccatgagcacctacggctggaacctcgtccggctgcagagcggggtggacgtgttcttcaccccgcccgagaagtgcgacaccctgctctgcgacatcggcgagtccagccccaaccccacgatcgaggccggccgcaccctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccacggggaacatcgtctccagcgtgaacatgatctcccgcatgctgatcaaccggttcaccatgaagcacaagaaggccacctacgagccggacgtggacctcggcagcgggacccgcaacatcggcatcgagaacgagatccccaacctggacatcatcggcaagcggatcgagaagatcaagcaggagcacgagacgtcctggcactacgaccaggaccacccctacaagacctgggcgtaccacgggagctacgagaccaagcagaccggctccgccagctccatggtcaacggggtggtgaagctgctcacgaagccctgggacgtcgtgccgatggtgacccagatggccatgaccgacaccacgcccttcggccagcagcgcgtcttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtgcgcagcaacgccgcgctgggcgccatcttcacggacgagaacaagtggaagtccgcccgggaggccgtcgaggacagccgcttctgggagctggtggaccgggagcgcaacctccacctggaggggaagtgcgagacctgcgtctacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtgagcaagaaggagggcggggccatgtacgcggacgacaccgccgggtgggacacccgcatcacgctggaggacctcaagaacgaggagatggtcaccaaccacatgaagggcgagcacaagaagctggccgaggccatcttcaagctgacctaccagaacaaggtggtgcgggtccagcgcccgacgccccgggggacggtgatggacatcatctcccggaaggaccagcgcggcagcggccaggtggggacctacggcctcaacaccttcaccaacatggaggcccagctgatccggcagatggagggggagggcatcttcaagtccatccagcgcctgacggtcaccgaggagatcgcggtgcagaactggctcgcccgggtgggccgcgagcggctgagccgcatggccatctccggggacgactgcgtcgtgaagcccctggacgaccggttcgccagcgccctcaccgcgctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcgggcgcgcccggatctcccagggcgccggctggagcctgaaggagacggcctgcctcgggaagtcctacgcccagatgtggaccctgatgtacttccaccgccgggacctgcgcctcgcggccaacgccatctgcagcgccgtgccctcccactgggtccccaccagccggaccacctggtccatccacgccaagcacgagtggatgacgaccgaggacatgctggcggtgtggaaccgcgtgtggatccaggagaacccgtggatggaggacaagacccccgtcgagagctgggaggaggtgccctacctgggcaagcgcgaggaccagtggtgcgggagcctcatcggcctgacctcccgggccacgtgggccaagaacatccagaccgccatcaaccaggtgcgcagcctgatcgggaacgaggagtacaccgactacatgccctccatgaagcggttccgcaaggaggaggaggaggcgggcgtcctctggtga

SEQ ID NO: 9428 - RNA, 9876 nt, synthetic construct
  misc_feature 1..9876: note = derived and/or modified CDS sequence (opt1) from DENV-2__EU687230__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgcggcacctccctgagcgtctccctcgtgctggtgggggtcgtgaccctgtacctcggcgtgatggtccaggccgacagcggctgcgtggtgtcctggaagaacaaggagctgaagtgcgggagcggcatcttcatcaccgacaacgtccacacgtggaccgagcagtacaagttccagcccgagtcccccagcaagctggcgagcgccatccagaaggcccacgaggaggggatctgcggcatccggtccgtgacccgcctcgagaacctgatgtggaagcagatcacccccgagctgaaccacatcctcagcgagaacgaggtgaagctgacgatcatgaccggggacatcaagggcatcatgcaggccggcaagcggtccctgcgcccgcagcccaccgagctcaagtacagctggaagacctgggggaaggccaagatgctgtccacggagagccacaaccagaccttcctgatcgacggccccgagaccgcggagtgcccgaacaccaaccgggcctggaactccctcgaggtcgaggactacgggttcggcgtgttcagcacgaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggggtgctcgagagcgagatgatcatccccaagaacttcgccggccccgtgtcccagcacaactaccgcccggggtaccacacccagaccgccggcccctggcacctggggaagctggagatggacttcgacttctgcgagggcacgaccgtcgtggtgaccgaggactgcggcaaccgggggcccagcctccgcaccacgaccgcgagcggcaagctgatcaccgagtggtgctgccggtcctgcaccctgcccccgctccgctaccgcggggaggacggctgctggtacgggatggagatccgccccctgaaggagaaggaggagaacctggtcaacagcctcgtgacggccggccacggccagatcgacaacttctccctgggggtgctgggcatggccctcttcctggaggagatgctgcggacccgcgtcgggaccaagcacgccatcctcctggtggcggtgagcttcgtcaccctgatcacgggcaacatgtccttccgggacctcgggcgcgtgatggtgatggtcggcgccaccatgaccgacgacatcggcatgggggtgacctacctggccctgctcgccgccttcaaggtgcgccccacgttcgcggccggcctgctgctccggaagctgaccagcaaggagctgatgatggccaccatcgggatcgccctcctgtcccagagcaccatccccgagacgatcctggagctcaccgacgccctggcgctgggcatgatggtcctcaagatcgtgcgcaacatggagaagtaccagctggccgtgaccatcatggccatctcctgcgtcccgaacgccgtgatcctgcagaacgcctggaaggtgagctgcaccatcctcgcggccgtctccgtgagccccctgctgctcacgtccagccagcagaaggccgactggatccccctggccctgaccatcaagggcctcaaccccaccgcgatcttcctgaccacgctgtcccggaccagcaagaagcgctcctggccgctcaacgaggccgtcatggccgtggggatggtgagcatcctggcctccagcctgctcaagaacgacatccccatgaccggccccctggtcgccgggggcctgctcaccgtgtgctacgtgctgacggggcggagcgcggacctggagctcgagcgcgccgccgacgtcaagtgggaggaccaggccgagatctccggcagctcccccatcctgagcatcaccatctccgaggacggcagcatgtccatcaagaacgaggaggaggagcacaccctgaccatcctcatccggacggggctgctggtgatcagcggcgtgttcccggtctccatccccatcaccgccgcggcctggtacctctgggaggtgaagaagcagcgcgccggggtgctgtgggacgtccccagcccgccgcccgtgggcaaggccgagctggaggacggggcctaccggatcaagcagcgcggcatcttcggctactcccagatcggggcgggcgtgtacaaggaggggaccttccacaccatgtggcacgtcacccggggcgccgtgctcatgcaccgcgggaagcggatcgagcccagctgggccgacgtgaagaaggacctgatctcctacggcggcgggtggaagctggagggcgagtggaaggagggggaggaggtccaggtgctcgccctggagcccggcaagaacccccgcgccgtgcagacgaagcccgggctgttcaagaccaacaccggcaccatcggcgcggtcagcctcgacttctcccccgggacgagcggctcccccatcgtggaccggaaggggaaggtggtcggcctgtacggcaacggggtggtgacccgcagcggcgcctacgtctccgccatcgcccagaccgagaagtccatcgaggacaaccccgagatcgaggacgacatcttccggaagaagcgcctgaccatcatggacctccaccccggggcgggcaagacgaagcggtacctgcccgccatcgtgcgcgaggccatcaagcgggggctgcgcaccctgatcctcgccccgacccgcgtggtcgccgcggagatggaggaggccctgcggggcctgcccatccgctaccagacccccgccatccgggccgagcacacgggccgcgagatcgtggacctcatgtgccacgccaccttcaccatgcggctgctgagccccgtgcgcgtcccgaactacaacctcatcatcatggacgaggcgcacttcaccgaccccgcctccatcgccgcccgggggtacatcagcacgcgcgtggagatgggcgaggccgcggggatcttcatgaccgccacgccgcccggctcccgggacccgttcccccagagcaacgcccccatcatggacgaggagcgcgagatccccgagcggtcctggaacagcgggcacgagtgggtgaccgacttcaagggcaagacggtctggttcgtgccgtccatcaaggccggcaacgacatcgcggcctgcctgcgcaagaacgggaagaaggtgatccagctgagccggaagaccttcgactccgagtacgtcaagacccgcgccaacgactgggacttcgtggtgaccacggacatcagcgagatgggcgccaacttccgggccgagcgcgtcatcgacccccggcgctgcatgaagcccgtgatcctcaccgacggggaggagcgggtgatcctggcgggccccatgccggtcacccactccagcgccgcccagcgccgcgggcggatcggccgcaaccccaagaacgagaacgaccagtacatctacatgggcgagcccctggagaacgacgaggactgcgcccactggaaggaggccaagatgctcctggacaacatcaacacccccgaggggatcatcccgtccatgttcgagcccgagcgggagaaggtggacgcgatcgacggcgagtaccgcctgcgcggggaggcccgcaagacgttcgtggacctcatgcggcgcggcgacctgcccgtctggctggcctaccgggtggccgccgaggggatcaactacgcggaccgccggtggtgcttcgacggcatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcggggcggaagtccctgaccctcaacctgatcaccgagatgggccgcctgcccacgttcatgacccagaaggcccgggacgccctcgacaacctggccgtgctgcacaccgccgaggtcgggggccgcgcgtacaaccacgccctcagcgagctgcccgagaccctggagacgctcctgctgctcaccctgctggccaccgtgaccggcgggatcttcctcttcctgatgtccggcaaggggatcggcaagatgacgctggggatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgaccgtggtcgccgccacgatggcgaacgagatgggcttcctggagaagaccaagaaggacctcggcctggggagcatcaccacccaggagagcgagtccaacatcctggacatcgacctccgcccggccagcgcctggacgctgtacgccgtggccaccaccttcgtgacccccatgctgcggcactccatcgagaacagctccgtcaacgtgagcctcacggcgatcgccaaccaggccaccgtgctgatgggcctggggcgcggctggcccctctccaagatggacatcggggtccccctgctggccatcggctgctacagccaggtgaacccgatcaccctcaccgcggccctgctgctcctggtggcccactacgccatcatcggccccgggctgcaggccaaggcgacgcgcgaggcccagaagcggaccgccgccggcatcatgaagaaccccaccgtcgacgggatcaccgtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgaccctggccacggggcccatctccaccctctgggagggcaaccccggccggttctggaacaccaccatcgccgtcagcatggccaacatcttccgcgggtcctacctggccggcgcggggctcctcttcagcatcatgaagaacacgaccaacacccggcgcggcaccggcaacatcggggagacgctgggcgagaagtggaagtcccggctgaacgccctcggcaagagcgagttccagatctacaagaagtccggcatccaggaggtggaccgcaccctggccaaggaggggatcaagcggggcgagaccgaccaccacgccgtgagccgcggctccgcgaagctgcggtggttcgtcgagcgcaacatggtgaccccggaggggaaggtggtcgacctcggctgcgggcggggcgggtggagctactactgcggcggcctgaagaacgtgcgcgaggtgaaggggctgacgaagggcgggcccggccacgaggagcccatccccatgtccacctacgggtggaacctcgtccggctgcagagcggcgtggacgtgttcttcaccccgcccgagaagtgcgacaccctgctctgcgacatcggcgagagctcccccaaccccacgatcgaggccgggcgcaccctgcgggtcctgaacctcgtggagaactggctgaacaacaacacccagttctgcatcaaggtgctgaacccgtacatgcccagcgtcatcgagaagatggagaccctccagcgcaagtacggcggggccctggtgcggaaccccctgtcccgcaacagcacccacgagatgtactgggtgtccaacgccacgggcaacatcgtcagctccgtgaacatgatcagccgcatgctgatcaaccggttcaccatgaagcacaagaaggccacctacgagccggacgtggacctcgggtccggcacccgcaacatcggcatcgagaacgagatccccaacctggacatcatcgggaagcggatcgagaagatcaagcaggagcacgagacgagctggcactacgaccaggaccacccctacaagacctgggcgtaccacggctcctacgagaccaagcagaccgggagcgcctccagcatggtcaacggcgtggtgaagctgctcacgaagccctgggacgtcgtgccgatggtgacccagatggccatgaccgacaccacgcccttcggccagcagcgcgtcttcaaggagaaggtggacacccggacccaggagcccaaggaggggaccaagaagctgatgcgcatcacggccgagtggctgtggaaggagctcggcaagaagaagacgccccggatgtgcacccgcgaggagttcacccggaaggtgcgctccaacgccgcgctgggggccatcttcacggacgagaacaagtggaagtccgcccgggaggccgtcgaggactcccgcttctgggagctggtggaccgggagcgcaacctccacctggagggcaagtgcgagacctgcgtctacaacatgatggggaagcgggagaagaagctgggcgagttcggcaaggccaaggggagccgcgcgatctggtacatgtggctcggcgcccggttcctggagttcgaggccctggggttcctcaacgaggaccactggttctcccgcggcaacagcctgagcggggtggagggcgagggcctgcacaagctcgggtacatcctgcgggacgtgtccaagaaggagggcggggccatgtacgcggacgacaccgccggctgggacacccgcatcacgctggaggacctcaagaacgaggagatggtcaccaaccacatgaagggggagcacaagaagctggccgaggccatcttcaagctgacctaccagaacaaggtggtgcgggtccagcgcccgacgccccggggcacggtgatggacatcatcagccggaaggaccagcgcggctccggccaggtggggacctacgggctcaacaccttcaccaacatggaggcccagctgatccggcagatggagggcgagggcatcttcaagagcatccagcgcctgacggtcaccgaggagatcgcggtgcagaactggctcgcccgggtggggcgcgagcggctgtcccgcatggccatcagcggcgacgactgcgtcgtgaagcccctggacgaccggttcgcctccgccctcaccgcgctgaacgacatggggaaggtgcgcaaggacatccagcagtgggagcccagccggggctggaacgactggacccaggtcccgttctgctcccaccacttccacgagctggtgatgaaggacgggcgcgtgctcgtcgtgccctgccggaaccaggacgagctgatcggccgcgcccggatcagccagggcgccgggtggtccctgaaggagacggcctgcctcggcaagagctacgcccagatgtggaccctgatgtacttccaccgccgggacctgcgcctcgcggccaacgccatctgctccgccgtgcccagccactgggtccccacctcccggaccacctggagcatccacgccaagcacgagtggatgacgaccgaggacatgctggcggtgtggaaccgcgtgtggatccaggagaacccgtggatggaggacaagacccccgtcgagtcctgggaggaggtgccctacctggggaagcgcgaggaccagtggtgcggcagcctcatcgggctgaccagccgggccacgtgggccaagaacatccagaccgccatcaaccaggtgcgctccctgatcggcaacgaggagtacaccgactacatgcccagcatgaagcggttccgcaaggaggaggaggaggcgggcgtcctctggtga

SEQ ID NO: 9429 - RNA, 9876 nt, synthetic construct
  misc_feature 1..9876: note = derived and/or modified CDS sequence (opt1) from DENV-2__EU687231__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgacggccgggcacggccagatcgacaacttcagcctgggcgtgctggggatggccctcttcctggaggagatgctgcggacccgcgtcggcaccaagcacgccatcctcctggtggcggtgtccttcgtcaccctgatcacggggaacatgagcttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtcatggccgtgggcatggtgtccatcctggccagcagcctgctcaagaacgacatccccatgaccgggcccctggtcgccggcgggctgctcaccgtgtgctacgtgctgacgggccggtccgcggacctggagctcgagcgcgccgccgacgtcaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtgttcccggtcagcatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacaccatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgcggtctccctcgacttcagccccggcacgtccgggagccccatcgtggaccggaagggcaaggtggtcgggctgtacggcaacggcgtggtgacccgctccggggcctacgtcagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtggtcgccgcggagatggaggaggccctgcgggggctgcccatccgctaccagacccccgccatccgggccgagcacacgggccgcgagatcgtggacctcatgtgccacgccaccttcaccatgcggctgctgtcccccgtgcgcgtcccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggccggcaacgacatcgcggcctgcctgcgcaagaacggcaagaaggtgatccagctgtcccggaagaccttcgacagcgagtacgtcaagacccgcgccaacgactgggacttcgtggtgaccacggacatctccgagatgggggccaacttccgggccgagcgcgtcatcgacccccggcgctgcatgaagcccgtgatcctcaccgacggcgaggagcgggtgatcctggcggggcccatgccggtcacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggtcggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtgacccccatgctgcggcacagcatcgagaactccagcgtcaacgtgtccctcacggcgatcgccaaccaggccaccgtgctgatggggctgggccgcgggtggcccctcagcaagatggacatcggcgtccccctgctggccatcgggtgctactcccaggtgaacccgatcaccctcaccgcggccctgctgctcctggtggcccactacgccatcatcggccccggcctgcaggccaaggcgacgcgcgaggcccagaagcggaccgccgccgggatcatgaagaaccccaccgtcgacggcatcaccgtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgaccctggccacgggccccatcagcaccctctgggaggggaaccccggccggttctggaacaccaccatcgccgtctccatggccaacatcttccgcggcagctacctggccggggcgggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgcgaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgacgaagggcgggcccgggcacgaggagcccatccccatgagcacctacggctggaacctcgtccggctgcagagcggggtggacgtgttcttcaccccgcccgagaagtgcgacaccctgctctgcgacatcggcgagtccagccccaaccccacgatcgaggccggccgcaccctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccacggggaacatcgtctccagcgtgaacatgatctcccgcatgctgatcaaccggttcaccatgaagcacaagaaggccacctacgagccggacgtggacctcggcagcgggacccgcaacatcggcatcgagaacgagatccccaacctggacatcatcggcaagcggatcgagaacatcaagcaggagcacgagacgtcctggcactacgaccaggaccacccctacaagacctgggcgtaccacgggagctacgagaccaagcagaccggctccgccagctccatggtcaacggggtggtgaagctgctcacgaagccctgggacgtcgtgccgatggtgacccagatggccatgaccgacaccacgcccttcggccagcagcgcgtcttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtgcgcagcaacgccgcgctgggcgccatcttcacggacgagaacaagtggaagtccgcccgggaggccgtcgaggacagccgcttctgggagctggtggaccgggagcgcaacctccacctggaggggaagtgcgagacctgcgtctacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtgagcaagaaggagggcggggccatgtacgcggacgacaccgccgggtgggacacccgcatcacgctggaggacctcaagaacgaggagatggtcaccaaccacatgaagggcgagcacaagaagctggccgaggccatcttcaagctgacctaccagaacaaggtggtgcgggtccagcgcccgacgccccgggggacggtgatggacatcatctcccggaaggaccagcgcggcagcggccaggtggggacctacggcctcaacaccttcaccaacatggaggcccagctgatccggcagatggagggggagggcatcttcaagtccatccagcgcctgacggtcaccgaggagatcgcggtgcagaactggctcgcccgggtgggccgcgagcggctgagccgcatggccatctccggggacgactgcgtcgtgaagcccctggacgaccggttcgccagcgccctcaccgcgctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcgggcgcgcccggatctcccagggcgccggctggagcctgaaggagacggcctgcctcgggaagtcctacgcccagatgtggaccctgatgtacttccaccgccgggacctgcgcctcgcggccaacgccatctgcagcgccgtgccctcccactgggtccccaccagccggaccacctggtccatccacgccaagcacgagtggatgacgaccgaggacatgctggcggtgtggaaccgcgtgtggatccaggagaacccgtggatggaggacaagacccccgtcgagagctgggaggaggtgccctacctgggcaagcgcgaggaccagtggtgcgggagcctcatcggcctgacctcccgggccacgtgggccaagaacatccagaccgccatcaaccaggtgcgcagcctgatcgggaacgaggagtacaccgactacatgccctccatgaagcggttccgcaaggaggaggaggaggcgggcgtcctctggtga

SEQ ID NO: 9430 - RNA, 9876 nt, synthetic construct
  misc_feature 1..9876: note = derived and/or modified CDS sequence (opt1) from DENV-2__EU687199__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatgatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctactcccagatcggcgcgggggtgtacaaggagggcaccttccacaccatgtggcacgtcacgcgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgccgtgcagaccaagcccggcctgttcaagaccaacaccgggacgatcggcgcggtcagcctcgacttctcccccggcaccagcgggtcccccatcgtggaccggaagggcaaggtggtcgggctgtacggcaacggcgtggtgacccgcagcggggcctacgtctccgccatcgcccagaccgagaagtccatcgaggacaaccccgagatcgaggacgacatcttccggaagaagcgcctgacgatcatggacctccaccccggcgcggggaagaccaagcggtacctgcccgccatcgtgcgcgaggccatcaagcggggcctgcgcaccctgatcctcgccccgacccgcgtggtcgccgcggagatggaggaggccctgcgggggctgcccatccgctaccagacgcccgccatccgggccgagcacaccggccgcgagatcgtggacctcatgtgccacgccaccttcaccatgcggctgctgagccccgtgcgcgtcccgaactacaacctcatcatcatggacgaggcgcacttcacggaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggccggcaacgacatcgcggcctgcctgcgcaagaacggcaagaaggtgatccagctgagccggaagaccttcgactccgagtacgtcaagacccgcgccaacgactgggacttcgtggtgacgaccgacatcagcgagatgggggccaacttccgggccgagcgcgtcatcgacccccggcgctgcatgaagcccgtgatcctcaccgacggcgaggagcgggtgatcctggcggggcccatgccggtcacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaaggcccgggacgccctcgacaacctggccgtgctgcacaccgccgaggtcggcgggcgcgcgtacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgacggtggtcgccgccaccatggcgaacgagatggggttcctggagaagaccaagaaggacctcggcctgggcagcatcaccacgcaggagagcgagtccaacatcctggacatcgacctccgcccggccagcgcctggaccctgtacgccgtggccaccaccttcgtgacgcccatgctgcggcactccatcgagaacagctccgtcaacgtgagcctcaccgcgatcgccaaccaggccaccgtgctgatggggctgggccgcgggtggcccctctccaagatggacatcggcgtccccctgctggccatcgggtgctacagccaggtgaacccgatcaccctcacggcggccctgctgctcctggtggcccactacgccatcatcggccccggcctgcaggccaaggcgacccgcgaggcccagaagcggaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgacgctggccaccggccccatctccaccctctgggaggggaaccccggccggttctggaacaccacgatcgccgtcagcatggccaacatcttccgcggctcctacctggccggggcgggcctcctcttcagcatcatgaagaacaccaccaacacccggcgcgggacgggcaacatcggcgagaccctgggggagaagtggaagtcccggctgaacgccctcggcaagagcgagttccagatctacaagaagtccgggatccaggaggtggaccgcaccctggccaaggagggcatcaagcgcggggagaccgaccaccacgccgtgagccgcggctccgcgaagctgcggtggttcgtcgagcgcaacatggtgacgccggagggcaaggtggtcgacctcgggtgcggccgcggcgggtggagctactactgcggcgggctgaagaacgtgcgcgaggtgaaggggctgaccaagggcgggcccgggcacgaggagcccatccccatgtccacctacggctggaacctcgtccggctgcagagcggggtggacgtgttcttcaccccgcccgagaagtgcgacacgctgctctgcgacatcggcgagagctcccccaaccccaccatcgaggccggccgcaccctgcgggtcctgaacctcgtggagaactggctgaacaacaacacccagttctgcgtgaaggtcctgaacccgtacatgcccagcgtgatcgagaagatggagaccctccagcgcaagtacgggggcgccctggtgcggaaccccctgtcccgcaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctcggctccgggacgcgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagaccaagcagacgggcagcgcctccagcatggtgaacggggtggtcaagctgctcaccaagccctgggacgtggtgccgatggtcacccagatggccatgaccgacacgacccccttcggccagcagcgcgtgttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtccgctccaacgccgcgctgggcgccatcttcaccgacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtctccaagaaggagggcggggccatgtacgcggacgacaccgccgggtgggacacgcgcatcaccctggaggacctcaagaacgaggagatggtgaccaaccacatgaagggcgagcacaagaagctggccgaggccatcttcaagctgacctaccagaacaaggtggtccgggtgcagcgcccgacgccccgcgggaccgtgatggacatcatcagccggaaggaccagcgcggctccggccaggtcgggacctacggcctcaacaccttcacgaacatggaggcccagctgatccggcagatggagggggagggcatcttcaagagcatccagcgcctgaccgtgaccgaggagatcgcggtgcagaactggctcgcccgggtcggccgcgagcggctgtcccgcatggccatcagcggggacgactgcgtggtgaagcccctggacgaccggttcgcctccgccctcaccgcgctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcccggatcagccagggcgccggctggtccctgaaggagaccgcctgcctcggcaagagctacgcccagatgtggaccctgatgtacttccaccgccgggacctgcgcctcgcggccaacgccatctgctccgccgtccccagccactgggtgcccacctcccggaccacgtggagcatccacgccaagcacgagtggatgaccaccgaggacatgctggcggtgtggaaccgcgtctggatccaggagaacccgtggatggaggacaagacccccgtggagtcctgggaggaggtgccctacctgggcaagcgcgaggaccagtggtgcgggagcctcatcggcctgacgagccgggccacctgggccaagaacatccagaccgccatcaaccaggtccgctccctgatcgggaacgaggagtacaccgactacatgcccagcatgaagcggttccgcaaggaggaggaggaggcgggcgtgctctggtga

SEQ ID NO: 9431 - RNA, 9876 nt, synthetic construct
  misc_feature 1..9876: note = derived and/or modified CDS sequence (opt1) from DENV-2__EU687235__SS-prME
  source 1..9876: mol_type = other RNA
accgccggggtgatcatcatgctgatccccaccgccatggcgttccacctcaccacccggaacggggagccgcacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgactcccggtgcccgacgcagggcgagcccagcctgaacgaggagcaggacaagcgcttcatctgcaagcactccatggtggaccggggctgggggaacggctgcggcctcttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtgttcccggtctccatccccatcaccgccgcggcctggtacctctgggaggtgaagaagcagcgcgccggcgtgctgtgggacgtccccagcccgcccctggtggggaaggccgagctcgaggacggcgcctaccggatcaagcagcgcgggatcttcggctactcccagatcggcgcgggggtgtacaaggagggcaccttccacaccatgtggcacgtcacgcgcggggccgtgctgatgcaccgcggcaagcggatcgagcccagctgggccgacgtgaagaaggacctgatctcctacgggggcggctggaagctcgagggggagtggaaggagggcgaggaggtccaggtgctggccctggagcccgggaagaacccccgcgccgtgcagaccaagcccggcctcttcaagaccaacaccgggacgatcggcgcggtcagcctggacttctcccccggcaccagcgggtcccccatcgtggaccggaagggcaaggtggtcgggctgtacggcaacggcgtggtgacccgcagcggggcctacgtctccgccatcgcccagaccgagaagtccatcgaggacaacccggagatcgaggacgacatcttccggaagaagcgcctcacgatcatggacctgcaccccggcgcggggaagaccaagcggtacctgcccgccatcgtgcgcgaggccatcaagcggggcctgcgcaccctcatcctggcccccacccgcgtggtcgccgcggagatggaggaggccctgcgggggctcccgatccgctaccagacgcccgccatccgggccgagcacaccggccgcgagatcgtggacctgatgtgccacgccaccttcaccatgcggctgctcagccccgtgcgcgtccccaactacaacctgatcatcatggacgaggcgcacttcacggacccggcctccatcgccgcccggggctacatcagcacccgcgtggagatgggggaggccgcgggcatcttcatgaccgccacgccgcccgggtcccgggaccccttcccgcagagcaacgcccccatcatggacgaggagcgcgagatccccgagcggtcctggaacagcggccacgagtgggtgacggacttcaaggggaagaccgtctggttcgtgccctccatcaaggccggcaacgacatcgcggcctgcctgcgcaagaacggcaagaaggtgatccagctcagccggaagaccttcgactccgagtacgtcaagacccgcgccaacgactgggacttcgtggtgacgaccgacatcagcgagatgggggccaacttccgggccgagcgcgtcatcgacccgcggcgctgcatgaagcccgtgatcctgaccgacggcgaggagcgggtgatcctggcggggcccatgcccgtcacccactccagcgccgcccagcgccgcggccggatcgggcgcaacccgaagaacgagaacgaccagtacatctacatgggcgagcccctcgagaacgacgaggactgcgcccactggaaggaggccaagatgctgctggacaacatcaacacgcccgagggcatcatcccctccatgttcgagccggagcgggagaaggtggacgcgatcgacggggagtaccgcctccggggcgaggcccgcaagaccttcgtggacctgatgcggcgcggggacctgcccgtctggctcgcctaccgggtggccgccgagggcatcaactacgcggaccgccggtggtgcttcgacgggatcaagaacaaccagatcctggaggagaacgtggaggtcgagatctggaccaaggagggcgagcgcaagaagctgaagccccggtggctcgacgcccgcatctacagcgacccgctggccctgaaggagttcaaggagttcgccgcgggccggaagtccctcaccctgaacctgatcacggagatggggcgcctccccaccttcatgacccagaaggcccgggacgccctggacaacctggccgtgctccacaccgccgaggtcggcgggcgcgcgtacaaccacgccctgagcgagctgcccgagacgctcgagaccctgctgctcctgaccctgctcgccaccgtgacgggcggcatcttcctgttcctgatgtccgggaagggcatcgggaagatgaccctcggcatgtgctgcatcatcaccgccagcatcctgctgtggtacgcccagatccagccccactggatcgcggcctccatcatcctcgagttcttcctgatcgtgctgctcatcccggagcccgagaagcagcggacgccccaggacaaccagctgacctacgtcgtgatcgccatcctgacggtggtcgccgccaccatggcgaacgagatggggttcctcgagaagaccaagaaggacctgggcctgggcagcatcaccacgcaggagagcgagtccaacatcctcgacatcgacctgcgccccgccagcgcctggaccctgtacgccgtggccaccaccttcgtgacgccgatgctccggcactccatcgagaacagctccgtcaacgtgagcctgaccgcgatcgccaaccaggccaccgtgctgatggggctcggccgcgggtggcccctgtccaagatggacatcggcgtccccctgctcgccatcgggtgctacagccaggtgaaccccatcaccctgacggcggccctgctcctgctggtggcccactacgccatcatcggcccgggcctccaggccaaggcgacccgcgaggcccagaagcggaccgccgccgggatcatgaagaaccccaccgtcgacggcatcacggtgatcgacctggagcccatcccctacgacccgaagttcgagaagcagctgggccaggtgatgctcctggtcctgtgcgtgacccaggtgctcatgatgcgcaccacctgggccctgtgcgaggcgctgacgctcgccaccggccccatctccaccctgtgggaggggaaccccggccggttctggaacaccacgatcgccgtcagcatggccaacatcttccgcggctcctacctggccggggcgggcctcctgttcagcatcatgaagaacaccaccaacacccggcgcgggacgggcaacatcggcgagaccctgggggagaagtggaagtcccggctcaacgccctgggcaagagcgagttccagatctacaagaagtccgggatccaggaggtggaccgcaccctggccaaggagggcatcaagcgcggggagaccgaccaccacgccgtgagccgcggctccgcgaagctccggtggttcgtcgagcgcaacatggtgacgcccgagggcaaggtggtcgacctggggtgcggccgcggcgggtggagctactactgcggcgggctgaagaacgtgcgcgaggtgaaggggctcaccaagggcgggccggggcacgaggagcccatccccatgtccacctacggctggaacctggtccggctgcagagcggggtggacgtgttcttcacgccgcccgagaagtgcgacacgctcctgtgcgacatcggcgagagctcccccaaccccaccatcgaggccggccgcaccctgcgggtcctcaacctggtggagaactggctgaacaacaacacccagttctgcgtgaaggtcctcaacccctacatgcccagcgtgatcgagaagatggagaccctgcagcgcaagtacgggggcgccctggtgcggaaccccctgtcccgcaacagcacgcacgagatgtactgggtctccaacgccaccgggaacatcgtgagctccgtgaacatgatcagccgcatgctcatcaaccggttcaccatgaagcacaagaaggccacctacgagcccgacgtcgacctgggctccgggacgcgcaacatcggcatcgagaacgagatcccgaacctggacatcatcggcaagcggatcgagaagatcaagcaggagcacgagaccagctggcactacgaccaggaccacccctacaagacctgggcgtaccacgggtcctacgagaccaagcagacgggcagcgcctccagcatggtgaacggggtggtcaagctcctgaccaagccctgggacgtggtgcccatggtcacccagatggccatgaccgacacgaccccgttcggccagcagcgcgtgttcaaggagaaggtggacacccggacccaggagcccaaggagggcacgaagaagctgatgcgcatcaccgccgagtggctctggaaggagctggggaagaagaagacgccccggatgtgcacccgcgaggagttcacgcggaaggtccgctccaacgccgcgctgggcgccatcttcaccgacgagaacaagtggaagtccgcccgggaggccgtggaggactcccgcttctgggagctcgtcgaccgggagcgcaacctgcacctggaggggaagtgcgagacctgcgtgtacaacatgatgggcaagcgggagaagaagctcggggagttcggcaaggccaagggcagccgcgcgatctggtacatgtggctgggggcccggttcctggagttcgaggccctcggcttcctgaacgaggaccactggttctcccgcgggaacagcctgagcggcgtggagggggagggcctccacaagctgggctacatcctgcgggacgtctccaagaaggagggcggggccatgtacgcggacgacaccgccgggtgggacacgcgcatcaccctcgaggacctgaagaacgaggagatggtgaccaaccacatgaagggcgagcacaagaagctggccgaggccatcttcaagctcacctaccagaacaaggtggtccgggtgcagcgccccacgccgcgcgggaccgtgatggacatcatcagccggaaggaccagcgcggctccggccaggtcgggacctacggcctgaacaccttcacgaacatggaggcccagctgatccggcagatggagggggagggcatcttcaagagcatccagcgcctcaccgtgaccgaggagatcgcggtgcagaactggctggcccgggtcggccgcgagcggctgtcccgcatggccatcagcggggacgactgcgtggtgaagcccctcgacgaccggttcgcctccgccctgaccgcgctgaacgacatgggcaaggtccgcaaggacatccagcagtgggagcccagccgggggtggaacgactggacccaggtgcccttctgctcccaccacttccacgagctcgtgatgaaggacggccgcgtcctggtggtgccgtgccggaaccaggacgagctgatcgggcgcgcccggatcagccagggcgccggctggtccctcaaggagaccgcctgcctgggcaagagctacgcccagatgtggaccctgatgtacttccaccgccgggacctccgcctggcggccaacgccatctgctccgccgtccccagccactgggtgcccacctcccggaccacgtggagcatccacgccaagcacgagtggatgaccaccgaggacatgctggcggtgtggaaccgcgtctggatccaggagaacccctggatggaggacaagaccccggtggagtcctgggaggaggtgccctacctcggcaagcgcgaggaccagtggtgcgggagcctgatcggcctgacgagccgggccacctgggccaagaacatccagaccgccatcaaccaggtccgctccctcatcgggaacgaggagtacaccgactacatgcccagcatgaagcggttccgcaaggaggaggaggaggcgggcgtgctgtggtga

SEQ ID NO: 9432 - RNA, 9876 nt, synthetic construct
  misc_feature 1..9876: note = derived and/or modified CDS sequence (opt1) from DENV-2__EU687236__SS-prME
  source 1..9876: mol_type = other RNA
accgccggggtgatcatcatgctgatccccaccgccatggcgttccacctcaccacccgcaacggggagccccacatgatcgtcgggcggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagaaggccgccgacgtcaagtgggaggaccaggccgagatctccgggagctcccccatcctgagcatcaccatctccgaggacggcagcatgtccatcaagaacgaggaggaggagcacaccctgacgatcctcatccgcaccggcctgctggtgatcagcggggtgttcccggtctccatccccatcaccgccgcggcctggtacctctgggaggtgaagaagcagcgggccggcgtgctgtgggacgtccccagcccgccgcccgtggggaaggccgagctggaggacggcgcctaccgcatcaagcagcgggggatcttcggctactcccagatcggcgcgggggtgtacaaggagggcaccttccacaccatgtggcacgtcacgcgcggggccgtgctcatgcaccggggcaagcgcatcgagcccagctgggccgacgtgaagaaggacctgatctcctacgggggcggctggaagctggagggggagtggaaggagggcgaggaggtccaggtgctcgccctggagcccgggaagaacccccgggccgtgcagaccaagcccggcctgttcaagaccaacaccgggacgatcggcgcggtcagcctcgacttctcccccggcaccagcgggtcccccatcgtggaccgcaagggcaaggtggtcgggctgtacggcaacggcgtggtgacccggagcggggcctacgtctccgccatcgcccagaccgagaagtccatcgaggacaaccccgagatcgaggacgacatcttccgcaagaagcggctgacgatcatggacctccaccccggcgcggggaagaccaagcgctacctgcccgccatcgtgcgggaggccatcaagcgcggcctgcggaccctgatcctcgccccgacccgcgtggtcgccgcggagatggaggaggccctgcgcgggctgcccatccggtaccagacgcccgccatccgcgccgagcacaccggccgggagatcgtggacctcatgtgccacgccaccttcaccatgcgcctgctgagccccgtgcgggtcccgaactacaacctcatcatcatggacgaggcgcacttcacggaccccgcctccatcgccgcccgcggctacatcagcacccgggtggagatgggggaggccgcgggcatcttcatgaccgccacgccgcccgggtcccgcgacccgttcccccagagcaacgcccccatcatggacgaggagcgggagatccccgagcgctcctggaacagcggccacgagtgggtgacggacttcaaggggaagaccgtctggttcgtgccgtccatcaaggccggcaacgacatcgcggcctgcctgcggaagaacggcaagaaggtgatccagctgagccgcaagaccttcgactccgagtacgtcaagacccgggccaacgactgggacttcgtggtgacgaccgacatcagcgagatgggggccaacttccgcgccgagcgggtcatcgacccccgccggtgcatgaagcccgtgatcctcaccgacggcgaggagcgcgtgatcctggcggggcccatgccggtcacccactccagcgccgcccagcggcgcggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgcgagaaggtggacgcgatcgacggggagtaccggctgcgcggcgaggcccggaagaccttcgtggacctcatgcgccgcggggacctgcccgtctggctggcctaccgcgtggccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctacagcgaccccctcgccctgaaggagttcaaggagttcgccgcgggccgcaagtccctgaccctcaacctgatcacggagatggggcggctgcccaccttcatgacccagaaggcccgcgacgccctcgacaacctggccgtgctgcacaccgccgaggtcggcgggcgggcgtacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcgcacgccccaggacaaccagctcacctacgtcgtgatcgccatcctgacggtggtcgccgccaccatggcgaacgagatggggttcctggagaagaccaagaaggacctcggcctgggcagcatcaccacgcaggagagcgagtccaacatcctggacatcgacctccggccggccagcgcctggaccctgtacgccgtggccaccaccttcgtgacgcccatgctgcgccactccatcgagaacagctccgtcaacgtgagcctcaccgcgatcgccaaccaggccaccgtgctgatggggctgggccgggggtggcccctctccaagatggacatcggcgtccccctgctggccatcgggtgctacagccaggtgaacccgatcaccctcacggcggccctgctgctcctggtggcccactacgccatcatcggccccggcctgcaggccaaggcgacccgcgaggcccagaagcgcaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcggaccacctgggccctctgcgaggcgctgacgctggccaccggccccatctccaccctctgggaggggaaccccggccgcttctggaacaccacgatcgccgtcagcatggccaacatcttccggggctcctacctggccggggcgggcctcctcttcagcatcatgaagaacaccaccaacacccgccgggggacgggcaacatcggcgagaccctgggggagaagtggaagtcccgcctgaacgccctcggcaagagcgagttccagatctacaagaagtccgggatccaggaggtggaccggaccctggccaaggagggcatcaagcgcggggagaccgaccaccacgccgtgagccggggctccgcgaagctgcgctggttcgtcgagcggaacatggtgacgccggagggcaaggtggtcgacctcgggtgcggccgcgggggctggagctactactgcgggggcctgaagaacgtgcgggaggtgaagggcctgaccaagggcgggcccgggcacgaggagcccatccccatgtccacctacggctggaacctcgtccgcctgcagagcggggtggacgtgttcttcaccccgcccgagaagtgcgacacgctgctctgcgacatcggcgagagctcccccaaccccaccatcgaggccggccggaccctgcgcgtcctgaacctcgtggagaactggctgaacaacaacacccagttctgcgtgaaggtcctgaacccgtacatgcccagcgtgatcgagaagatggagaccctccagcggaagtacgggggcgccctggtgcgcaaccccctgtcccggaacagcacgcacgagatgtactgggtctccaacgccaccgggaacatcgtgagctccgtgaacatgatcagccgcatgctgatcaaccgcttcaccatgaagcacaagaaggccacctacgagccggacgtcgacctcggctccgggacgcggaacatcggcatcgagaacgagatccccaacctggacatcatcggcaagcgcatcgagaagatcaagcaggagcacgagaccagctggcactacgaccaggaccacccctacaagacctgggcgtaccacgggtcctacgagaccaagcagacgggcagcgcctccagcatggtgaacggggtggtcaagctgctcaccaagccctgggacgtggtgccgatggtcacccagatggccatgaccgacacgacccccttcggccagcagcgggtgttcaaggagaaggtggacacccgcacccaggagcccaaggagggcacgaagaagctgatgcggatcaccgccgagtggctgtggaaggagctcgggaagaagaagacgccccgcatgtgcacccgggaggagttcacgaagaaggtccgctccaacgccgcgctgggcgccatcttcaccgacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtctccaagaaggagggcggggccatgtacgcggacgacaccgccgggtgggacacgcgcatcaccctggaggacctcaagaacgaggagatggtgaccaaccacatgaagggcgagcacaagaagctggccgaggccatcttcaagctgacctaccagaacaaggtggtccgggtgcagcgcccgacgccccgggggaccgtgatggacatcatcagccgcaaggaccagcgcggctccggccaggtcgggacctacggcctcaacaccttcacgaacatggaggcccagctgatccggcagatggagggggagggcatcttcaagagcatccagcgcctgaccgtgaccgaggagatcgcggtgcagaactggctcgcccgggtcggccgcgagcggctgtcccgcatggccatcagcggggacgactgcgtggtgaagcccctggacgaccggttcgcctccgccctcaccgcgctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcccggatcagccagggcgccggctggtccctgaaggagaccgcctgcctcggcaagagctacgcccagatgtggaccctgatgtacttccaccgccgggacctgcgcctcgcggccaacgccatctgctccgccgtccccagccactgggtgcccacctcccggaccacgtggagcatccacgccaagcacgagtggatgaccaccgaggacatgctggcggtgtggaaccgcgtctggatccaggagaacccgtggatggaggacaagacccccgtggagtcctgggaggaggtgccctacctgggcaagcgggaggaccagtggtgcgggagcctcatcggcctgacgagccgcgccacctgggccaagaacatccagaccgccatcaaccaggtccgctccctgatcgggaacgaggagtacaccgactacatgcccagcatgaagcggttccgcaaggaggaggaggaggcgggcgtgctctggtga

SEQ ID NO: 9433 - RNA, 9876 nt, synthetic construct
  misc_feature 1..9876: note = derived and/or modified CDS sequence (opt1) from DENV-2__EU687237__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctactcccagatcggcgcgggggtgtacaaggagggcaccttccacaccatgtggcacgtcacgcgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgccgtgcagaccaagcccggcctgttcaagaccaacaccgggacgatcggcgcggtcagcctcgacttctcccccggcaccagcgggtcccccatcgtggaccggaagggcaaggtggtcgggctgtacggcaacggcgtggtgacccgcagcggggcctacgtctccgccatcgcccagaccgagaagtccatcgaggacaaccccgagatcgaggacgacatcttccggaagaagcgcctgacgatcatggacctccaccccggcgcggggaagaccaagcggtacctgcccgccatcgtgcgcgaggccatcaagcggggcctgcgcaccctgatcctcgccccgacccgcgtggtcgccgcggagatggaggaggccctgcgggggctgcccatccgctaccagacgcccgccatccgggccgagcacaccggccgcgagatcgtggacctcatgtgccacgccaccttcaccatgcggctgctgagccccgtgcgcgtcccgaactacaacctcatcatcatggacgaggcgcacttcacggaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggccggcaacgacatcgcggcctgcctgcgcaagaacggcaagaaggtgatccagctgagccggaagaccttcgactccgagtacgtcaagacccgcgccaacgactgggacttcgtggtgacgaccgacatcagcgagatgggggccaacttccgggccgagcgcgtcatcgacccccggcgctgcatgaagcccgtgatcctcaccgacggcgaggagcgggtgatcctggcggggcccatgccggtcacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaaggcccgggacgccctcgacaacctggccgtgctgcacaccgccgaggtcggcgggcgcgcgtacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtcgtgatcgccatcctgacggtggtcgccgccaccatggcgaacgagatggggttcctggagaagaccaagaaggacctcggcctgggcagcatcaccacgcaggagagcgagtccaacatcctggacatcgacctccgcccggccagcgcctggaccctgtacgccgtggccaccaccttcgtgacgcccatgctgcggcactccatcgagaacagctccgtcaacgtgagcctcaccgcgatcgccaaccaggccaccgtgctgatggggctgggccgcgggtggcccctctccaagatggacatcggcgtccccctgctggccatcgggtgctacagccaggtgaacccgatcaccctcacggcggccctgctgctcctggtggcccactacgccatcatcggccccggcctgcaggccaaggcgacccgcgaggcccagaagcggaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgacgctggccaccggccccatctccaccctctgggaggggaaccccggccggttctggaacaccacgatcgccgtcagcatggccaacatcttccgcggctcctacctggccggggcgggcctcctcttcagcatcatgaagaacaccaccaacacccggcgcgggacgggcaacatcggcgagaccctgggggagaagtggaagtcccggctgaacgccctcggcaagagcgagttccagatctacaagaagtccgggatccaggaggtggaccgcaccctggccaaggagggcatcaagcgcggggagaccgaccaccacgccgtgagccgcggctccgcgaagctgcggtggttcgtcgagcgcaacatggtgacgccggagggcaaggtggtcgacctcgggtgcggccgcggcgggtggagctactactgcggcgggctgaagaacgtgcgcgaggtgaaggggctgaccaagggcgggcccgggcacgaggagcccatccccatgtccacctacggctggaacctcgtccggctgcagagcggggtggacgtgttcttcaccccgcccgagaagtgcgacacgctgctctgcgacatcggcgagagctcccccaaccccaccatcgaggccggccgcaccctgcgggtcctgaacctcgtggagaactggctgaacaacaacacccagttctgcgtgaaggtcctgaacccgtacatgcccagcgtgatcgagaagatggagaccctccagcgcaagtacgggggcgccctggtgcggaaccccctgtcccgcaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctcggctccgggacgcgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagaccaagcagacgggcagcgcctccagcatggtgaacggggtggtcaagctgctcaccaagccctgggacgtggtgccgatggtcacccagatggccatgaccgacacgacccccttcggccagcagcgcgtgttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtccgctccaacgccgcgctgggcgccatcttcaccgacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtctccaagaaggagggcggggccatgtacgcggacgacaccgccgggtgggacacgcgcatcaccctggaggacctcaagaacgaggagatggtgaccaaccacatgaagggcgagcacaagaagctggccgaggccatcttcaagctgacctaccagaacaaggtggtccgggtgcagcgcccgacgccccgcgggaccgtgatggacatcatcagccggaaggaccagcgcggctccggccaggtcgggacctacggcctcaacaccttcacgaacatggaggcccagctgatccggcagatggagggggagggcatcttcaagagcatccagcgcctgaccgtgaccgaggagatcgcggtgcagaactggctcgcccgggtcggccgcgagcggctgtcccgcatggccatcagcggggacgactgcgtggtgaagcccctggacgaccggttcgcctccgccctcaccgcgctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcccggatcagccagggcgccggctggtccctgaaggagaccgcctgcctcggcaagagctacgcccagatgtggaccctgatgtacttccaccgccgggacctgcgcctcgcggccaacgccatctgctccgccgtccccagccactgggtgcccacctcccggaccacgtggagcatccacgccaagcacgagtggatgaccaccgaggacatgctggcggtgtggaaccgcgtctggatccaggagaacccgtggatggaggacaagacccccgtggagtcctgggaggaggtgccctacctgggcaagcgcgaggaccagtggtgcgggagcctcatcggcctgacgagccgggccacctgggccaagaacatccagaccgccatcaaccaggtccgctccctgatcgggaacgaggagtacaccgactacatgcccagcatgaagcggttccgcaaggaggaggaggaggcgggcgtgctctggtga

SEQ ID NO: 9434 - RNA, 9876 nt, synthetic construct
  misc_feature 1..9876: note = derived and/or modified CDS sequence (opt1) from DENV-2__EU687238__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgacgatcacctggatcgggatgaacagccgctccaccagcctgtccgtcagcctcgtgctggtgggcgtcgtgaccctgtacctcggggtgatggtccaggccgacacgggctgcgtggtgtcctggaagaacaaggagctgaagtgcggcagcgggatcttcatcaccgacaacgtccacacctggaccgagcagtacaagttccagcccgagtcccccagcaagctggcgagcgccatccagaaggcccacgaggagggcatctgcgggatccggtccgtgacgcgcctcgagaacctgatgtggaagcagatcacccccgagctgaaccacatcctcagcgagaacgaggtgaagctgaccatcatgaccggcgacatcaaggggatcatgcaggccggcaagcggtccctgcgcccgcagcccacggagctcaagtacagctggaagacctggggcaaggccaagatgctgtccaccgagagccacaaccagaccttcctgatcgacgggcccgagacggcggagtgcccgaacaccaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacgcagaccgccgggccctggcacctgggcaagctggagatggacttcgacttctgcgaggggaccaccgtcgtggtgacggaggactgcggcaaccggggccccagcctccgcaccaccaccgcgagcgggaagctgatcacggagtggtgctgccggtcctgcaccctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcacgaagcacgccatcctcctggtggcggtgagcttcgtcaccctgatcaccgggaacatgtccttccgggacctcggccgcgtgatggtgatggtcggggccaccatgacggacgacatcggcatgggcgtgacctacctggccctgctcgccgccttcaaggtgcgccccaccttcgcggccgggctgctgctccggaagctgaccagcaaggagctgatgatggccacgatcggcatcgccctcctgtcccagagcaccatccccgagaccatcctggagctcaccgacgccctggcgctggggatgatggtcctcaagatcgtgcgcaacatggagaagtaccagctggccgtgacgatcatggccatctcctgcgtcccgaacgccgtgatcctgcagaacgcctggaaggtgagctgcaccatcctcgcggccgtctccgtgagccccctgctgctcacctccagccagcagaaggccgactggatccccctggccctgaccatcaagggcctcaaccccacggcgatcttcctgaccaccctgtcccggaccagcaagaagcgctcctggccgctcaacgaggccgtcatggccgtgggcatggtgagcatcctggcctccagcctgctcaagaacgacatccccatgacggggcccctggtcgccggcgggctgctcaccgtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacacgctgaccatcctcatccggaccggcctgctggtgatcagcggggtgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctactcccagatcggcgcgggggtgtacaaggagggcaccttccacacgatgtggcacgtcacccgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgccgtgcagaccaagcccggcctgttcaagaccaacacggggaccatcggcgcggtcagcctcgacttctcccccggcaccagcgggtcccccatcgtggaccggaagggcaaggtggtcgggctgtacggcaacggcgtggtgacccgcagcggggcctacgtctccgccatcgcccagacggagaagtccatcgaggacaaccccgagatcgaggacgacatcttccggaagaagcgcctgaccatcatggacctccaccccggcgcggggaagaccaagcggtacctgcccgccatcgtgcgcgaggccatcaagcggggcctgcgcaccctgatcctcgccccgacgcgcgtggtcgccgcggagatggaggaggccctgcgggggctgcccatccgctaccagacccccgccatccgggccgagcacaccggccgcgagatcgtggacctcatgtgccacgccaccttcacgatgcggctgctgagccccgtgcgcgtcccgaactacaacctcatcatcatggacgaggcgcacttcaccgaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgaccgacttcaaggggaagaccgtctggttcgtgccgtccatcaaggccggcaacgacatcgcggcctgcctgcgcaagaacggcaagaaggtgatccagctgagccggaagaccttcgactccgagtacgtcaagacgcgcgccaacgactgggacttcgtggtgaccaccgacatcagcgagatgggggccaacttccgggccgagcgcgtcatcgacccccggcgctgcatgaagcccgtgatcctcaccgacggcgaggagcgggtgatcctggcggggcccatgccggtcacgcactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgtccatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcgggccggaagtccctgacgctcaacctgatcaccgagatggggcgcctgcccaccttcatgacccagaaggcccgggacgccctcgacaacctggccgtgctgcacacggccgaggtcggcgggcgcgcgtacaaccacgccctcagcgagctgcccgagaccctggagaccctcctgctgctcaccctgctggccacggtgaccggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacgtacgtcgtgatcgccatcctgaccgtggtcgccgccaccatggcgaacgagatggggttcctggagaagaccaagaaggacctcggcctgggcagcatcacgacccaggagagcgagtccaacatcctggacatcgacctccgcccggccagcgcctggaccctgtacgccgtggccaccacgttcgtgacccccatgctgcggcactccatcgagaacagctccgtcaacgtgagcctcaccgcgatcgccaaccaggccaccgtgctgatggggctgggccgcgggtggcccctctccaagatggacatcggcgtccccctgctggccatcgggtgctacagccaggtgaacccgatcacgctcaccgcggccctgctgctcctggtggcccactacgccatcatcggccccggcctgcaggccaaggcgacccgcgaggcccagaagcggaccgccgccgggatcatgaagaaccccacggtcgacggcatcaccgtgatcgacctcgagcccatcccgtacgaccccaagttcgagaagcagctgggccaggtgatgctgctcgtcctgtgcgtgacccaggtgctgatgatgcgcaccacgtgggccctctgcgaggcgctgaccctggccaccggccccatctccaccctctgggaggggaaccccggccggttctggaacacgaccatcgccgtcagcatggccaacatcttccgcggctcctacctggccggggcgggcctcctcttcagcatcatgaagaacaccaccaacacgcggcgcgggaccggcaacatcggcgagaccctgggggagaagtggaagtcccggctgaacgccctcggcaagagcgagttccagatctacaagaagtccgggatccaggaggtggaccgcaccctggccaaggagggcatcaagcgcggggagacggaccaccacgccgtgagccgcggctccgcgaagctgcggtggttcgtcgagcgcaacatggtgaccccggagggcaaggtggtcgacctcgggtgcggccgcggcgggtggagctactactgcggcgggctgaagaacgtgcgcgaggtgaaggggctgaccaagggcgggcccgggcacgaggagcccatccccatgtccacctacggctggaacctcgtccggctgcagagcggggtggacgtgttcttcacgccgcccgagaagtgcgacaccctgctctgcgacatcggcgagagctcccccaaccccaccatcgaggccggccgcaccctgcgggtcctgaacctcgtggagaactggctgaacaacaacacccagttctgcgtgaaggtcctgaacccgtacatgcccagcgtgatcgagaagatggagacgctccagcgcaagtacgggggcgccctggtgcggaaccccctgtcccgcaacagcacccacgagatgtactgggtctccaacgccaccgggaacatcgtgagctccgtgaacatgatcagccgcatgctgatcaaccggttcaccatgaagcacaagaaggccacgtacgagccggacgtcgacctcggctccgggacccgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagacgaagcagaccggcagcgcctccagcatggtgaacggggtggtcaagctgctcaccaagccctgggacgtggtgccgatggtcacccagatggccatgacggacaccacccccttcggccagcagcgcgtgttcaaggagaaggtggacacccggacgcaggagcccaaggagggcaccaagaagctgatgcgcatcaccgccgagtggctgtggaaggagctcgggaagaagaagacgccccggatgtgcacgcgcgaggagttcacccggaaggtccgctccaacgccgcgctgggcgccatcttcaccgacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtctccaagaaggagggcggggccatgtacgcggacgacacggccgggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccgggggaccgtgatggacatcatcagccggaaggaccagcgcggctccggccaggtcgggacctacggcctcaacacgttcaccaacatggaggcccagctgatccggcagatggagggggagggcatcttcaagagcatccagcgcctgaccgtgaccgaggagatcgcggtgcagaactggctcgcccgggtcggccgcgagcggctgtcccgcatggccatcagcggggacgactgcgtggtgaagcccctggacgaccggttcgcctccgccctcacggcgctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcccggatcagccagggcgccggctggtccctgaaggagaccgcctgcctcggcaagagctacgcccagatgtggaccctgatgtacttccaccgccgggacctgcgcctcgcggccaacgccatctgctccgccgtccccagccactgggtgcccacctcccggacgacctggagcatccacgccaagcacgagtggatgaccaccgaggacatgctggcggtgtggaaccgcgtctggatccaggagaacccgtggatggaggacaagacgcccgtggagtcctgggaggaggtgccctacctgggcaagcgcgaggaccagtggtgcgggagcctcatcggcctgaccagccgggccacctgggccaagaacatccagaccgccatcaaccaggtccgctccctgatcgggaacgaggagtacacggactacatgcccagcatgaagcggttccgcaaggaggaggaggaggcgggcgtgctctggtga

SEQ ID NO: 9435 - RNA, 9876 nt, synthetic construct
  misc_feature 1..9876: note = derived and/or modified CDS sequence (opt1) from DENV-2__EU687240__SS-prME
  source 1..9876: mol_type = other RNA
accgtgggcgtcatcatcatgctgatccccaccgccatggccttccacctcaccacccgcaacggggagccccacatgatcgtgggccggcaggagaaggggaagtccctgctgttcaagaccgaggacggcgtgaacatgtgcaccctcatggcgatcgacctgggggagctgtgcgaggacaccatcacctacaagtgccccctcctgcggcagaacgagcccgaggacatcgactgctggtgcaacagcaccagcacctgggtcacctacgggacctgcaccaccacgggcgagcaccggcgcgagaagcggtccgtggccctggtgccccacgtcgggatgggcctcgagacccgcaccgagacctggatgagcagcgagggggcctggaagcacgtgcagcggatcgagacctggatcctgcgccacccgggcttcaccatcatggccgccatcctggcgtacaccatcgggaccacgcacttccagcgggccctcatcttcatcctgctgaccgccgtggcccccagcatgaccatgcgctgcatcggcatctccaaccgggacttcgtcgagggcgtgagcgggggctcctgggtggacatcgtcctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgccatgttcacgtgcaagaagaacatggagggcaaggtggtgctgcccgagaacctggagtacaccatcgtcatcacgccccacagcggggaggagcacgcggtgggcaacgacaccgggaagcacggcaaggagatcaagatcaccccgcagtccagcatcaccgaggccgagctcaccgggtacggcacggtgaccatggagtgcagcccccggaccggcctggacttcaacgagatggtcctgctccagatggaggacaaggcctggctggtgcaccggcagtggttcctggacctccccctgccctggctgccgggggccgacacccagggcagcaactggatccagaaggagacgctcgtgaccttcaagaacccccacgccaagaagcaggacgtcgtggtcctggggtcccaggagggcgcgatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtgaaggagatcgccgagacccagcacgggacgatcgtgatccgcgtccagtacgagggcgacggctccccctgcaagatccccttcgagatcatggacctcgagaagcggcacgtgctggggcgcctgatcaccgtgaacccgatcgtcaccgagaaggacagccccgtgaacatcgaggccgagccgcccttcggcgactcctacatcatcatcggggtggagccgggccagctcaagctgaactggttcaagaaggggagctccatcggccagatgttcgagaccacgatgcgcggcgcgaagcggatggccatcctgggggacaccgcctgggacttcggcagcctcgggggcgtcttcacctccatcgggaaggccctgcaccaggtgttcggcgccatctacggcgcggccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgactccggctgcgtggtcagctggaagaacaaggagctgaagtgcggctccgggatcttcatcaccgacaacgtgcacacgtggaccgagcagtacaagttccagcccgagagccccagcaagctggcctccgcgatccagaaggcccacgaggagggcatctgcgggatccggagcgtgacccgcctcgagaacctgatgtggaagcagatcacccccgagctgaaccacatcctctccgagaacgaggccaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgacggccgggcacggccagatcgacaacttcagcctgggcgtgctggggatggccctcttcctggaggagatgctgcggacccgcgtcggcaccaagcacgccatcctcctggtggcggtgtccttcgtcaccctgatcacggggaacatgagcttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtcatggccgtgggcatggtgtccatcctggccagcagcctgctcaagaacgacatccccatgaccgggcccctggtcgccggcgggctgctcaccgtgtgctacgtgctgacgggccggtccgcggacctggagctcgagcgcgccgccgacgtcaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtgttcccggtcagcatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacaccatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagacgaagcccggcctgttcaagaccaacaccgggaccatcggcgcggtctccctcgacttcagccccggcacgtccgggagccccatcgtggaccggaagggcaaggtggtcgggctgtacggcaacggcgtggtgacccgctccggggcctacgtcagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtggtcgccgcggagatggaggaggccctgcgggggctgcccatccgctaccagacccccgccatccgggccgagcacacgggccgcgagatcgtggacctcatgtgccacgccaccttcaccatgcggctgctgtcccccgtgcgcgtcccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagacggtctggttcgtgccgagcatcaaggccggcaacgacatcgcggcctgcctgcgcaagaacggcaagaaggtgatccagctgtcccggaagaccttcgacagcgagtacgtcaagacccgcgccaacgactgggacttcgtggtgaccacggacatctccgagatgggggccaacttccgggccgagcgcgtcatcgacccccggcgctgcatgaagcccgtgatcctcaccgacggcgaggagcgggtgatcctggcggggcccatgccggtcacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtgctgcacaccgccgaggtcggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgaccgtggtcgccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtgacccccatgctgcggcacagcatcgagaactccagcgtcaacgtgtccctcacggcgatcgccaaccaggccaccgtgctgatggggctgggccgcgggtggcccctcagcaagatggacatcggcgtccccctgctggccatcgggtgctactcccaggtgaacccgatcaccctcaccgcggccctgctgctcctggtggcccactacgccatcatcggccccggcctgcaggccaaggcgacgcgcgaggcccagaagcggaccgccgccgggatcatgaagaaccccaccgtcgacggcatcaccgtgatcgacctcgagcccatcccgtacgaccccaagttcgagaagcagctggggcaggtcatgctgctcgtcctgtgcgtgacccaggtgctgatgatgcgcaccacctgggccctctgcgaggcgctgaccctggccacgggccccatcagcaccctctgggaggggaaccccggccggttctggaacaccaccatcgccgtctccatggccaacatcttccgcggcagctacctggccggggcgggcctcctcttctccatcatgaagaacacgaccaacacccggcgcgggaccggcaacatcggcgagacgctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgcgaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgacgaagggcgggcccgggcacgaggagcccatccccatgagcacctacggctggaacctcgtccggctgcagagcggggtggacgtgttcttcaccccgcccgagaagtgcgacaccctgctctgcgacatcggcgagtccagccccaaccccacgatcgaggccggccgcaccctgcgggtcctgaacctcgtggagaactggctgaacaacaacacccagttctgcatcaaggtgctgaacccgtacatgccctccgtcatcgagaagatggagaccctccagcgcaagtacgggggcgccctggtgcggaaccccctgagccgcaactccacccacgagatgtactgggtgagcaacgccacggggaacatcgtctccagcgtgaacatgatctcccgcatgctgatcaaccggttcaccatgaagcacaagaaggccacctacgagccggacgtggacctcggcagcgggacccgcaacatcggcatcgagaacgagatccccaacctggacatcatcggcaagcggatcgagaagatcaagcaggagcacgagacgtcctggcactacgaccaggaccacccctacaagacctgggcgtaccacgggagctacgagaccaagcagaccggctccgccagctccatggtcaacggggtggtgaagctgctcacgaagccctgggacgtcgtgccgatggtgacccagatggccatgaccgacaccacgcccttcggccagcagcgcgtcttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtgcgcagcaacgccgcgctgggcgccatcttcacggacgagaacaagtggaagtccgcccgggaggccgtcgaggacagccgcttctgggagctggtggaccgggagcgcaacctccacctggaggggaagtgcgagacctgcgtctacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtgagcaagaaggagggcggcgccatgtacgcggacgacaccgccgggtgggacacccgcatcacgctggaggacctcaagaacgaggagatggtcaccaaccacatgaagggcgagcacaagaagctggccgaggccatcttcaagctgacctaccagaacaaggtggtgcgggtccagcgcccgacgccccgggggacggtgatggacatcatctcccggaaggaccagcgcggcagcggccaggtggggacctacggcctcaacaccttcaccaacatggaggcccagctgatccggcagatggagggggagggcatcttcaagtccatccagcgcctgacggtcaccgaggagatcgcggtgcagaactggctcgcccgggtgggccgcgagcggctgagccgcatggccatctccggggacgactgcgtcgtgaagcccctggacgaccggttcgccagcgccctcaccgcgctgaacgacatgggcaaggtgcgcaaggacatccagcagtgggagccctcccgggggtggaacgactggacccaggtcccgttctgcagccaccacttccacgagctggtgatgaaggacggccgcgtgctcgtcgtgccctgccggaaccaggacgagctgatcgggcgcgcccggatctcccagggcgccggctggagcctgaaggagacggcctgcctcgggaagtcctacgcccagatgtggaccctgatgtacttccaccgccgggacctgcgcctcgcggccaacgccatctgcagcgccgtgccctcccactgggtccccaccagccggaccacctggtccatccacgccaagcacgagtggatgacgaccgaggacatgctggcggtgtggaaccgcgtgtggatccaggagaacccgtggatggaggacaagacccccgtcgagagctgggaggaggtgccctacctgggcaagcgcgaggaccagtggtgcgggagcctcatcggcctgacctcccgggccacgtgggccaagaacatccagaccgccatcaaccaggtgcgcagcctgatcgggaacgaggagtacaccgactacatgccctccatgaagcggttccgcaaggaggaggaggaggcgggcgtcctctggtga

SEQ ID NO: 9436 - RNA, 9876 nt, synthetic construct
  misc_feature 1..9876: note = derived and/or modified CDS sequence (opt1) from DENV-2__EU687241__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacagcatcgggaccacccacttccagcgggccctcatcttcatcctgctgacggccgtggcgccctccatgaccatgcgctgcatcggcatcagcaaccgggacttcgtggagggcgtctccgggggcagctgggtggacatcgtgctcgagcacgggtcctgcgtcaccaccatggccaagaacaagcccacgctggacttcgagctgaccaagaccgaggccaagcagcccgccaccctccgcaagtactgcatcgaggccaagctgacgaacaccaccaccgagagccggtgcccgacgcagggcgagccctccctgaacgaggagcaggacaagcgcttcatctgcaagcacagcatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccactccggggaggagcacgccgtcggcaacgacaccgggaagcacggcaaggagatcaagatcaccccgcagagctccatcaccgaggccgagctcaccgggtacggcacggtgaccatggagtgcagcccccgcaccggcctggacttcaacgagatggtgctgctccagatggaggacaaggcctggctggtccaccggcagtggttcctggacctccccctgccctggctgccgggggccgacacccagggctccaactggatccagaaggagacgctcgtgaccttcaagaacccccacgcgaagaagcaggacgtggtcgtgctggggagccaggagggcgccatgcacaccgccctgaccggggccacggagatccagatgagctccggcaacctcctgttcaccggccacctgaagtgccgcctccggatggacaagctgcagctgaaggggatgagctactccatgtgcaccggcaagttcaagatcgtcaaggagatcgccgagacccagcacgggacgatcgtgatccgcgtgcagtacgagggcgacggcagcccctgcaagatccccttcgagatcatggacctcgagaagcggcacgtcctggggcgcctgatcaccgtgaacccgatcgtgaccgagaaggactcccccgtcaacatcgaggcggagccgcccttcggcgacagctacatcatcatcggggtggagccgggccagctcaagctgaactggttcaagaaggggtccagcatcggccagatgttcgagaccacgatgcgcggcgccaagcggatggccatcctgggggacaccgcctgggacttcggctccctcgggggcgtgttcaccagcatcgggaaggccctgcaccaggtcttcggcgcgatctacggcgccgccttctccggggtgagctggaccatgaagatcctgatcggcgtgatcatcacgtggatcgggatgaactcccgcagcacctccctgagcgtctccctcgtgctggtgggcgtcgtgaccctgtacctcggggtgatggtccaggccgacaccggctgcgtggtgagctggaagaacaaggagctgaagtgcggctccgggatcttcatcacggacaacgtccacacctggaccgagcagtacaagttccagcccgagagccccagcaagctggcgtccgccatccagaaggcccacgaggagggcatctgcgggatccggagcgtgacccgcctcgagaacctgatgtggaagcagatcacgcccgagctgaaccacatcctctccgagaacgaggtgaagctgaccatcatgaccggcgacatcaaggggatcatgcaggccggcaagcggagcctgcgcccgcagcccaccgagctcaagtactcctggaagacgtggggcaaggccaagatgctgagcaccgagtcccacaaccagaccttcctgatcgacgggcccgagaccgcggagtgcccgaacacgaaccgggcctggaacagcctcgaggtcgaggactacggcttcggggtgttctccaccaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgtccgggaagctgatcaccgagtggtgctgccggagctgcacgctgcccccgctccgctaccggggcgaggacgggtgctggtacggcatggagatccgccccctgaaggagaaggaggagaacctggtcaactccctcgtgaccgccgggcacggccagatcgacaacttcagcctgggcgtgctggggatggccctcttcctggaggagatgctgcggacccgcgtcggcaccaagcacgccatcctcctggtggcggtgtccttcgtcacgctgatcaccgggaacatgagcttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgacctccaaggagctgatgatggccaccatcggcatcgccctcctgagccagtccacgatccccgagaccatcctggagctcaccgacgccctggcgctggggatgatggtcctcaagatcgtgcgcaccatggagaagtaccagctggccgtgacgatcatggccatcagctgcgtcccgaacgccgtgatcctgcagaacgcctggaaggtgtcctgcaccatcctcgcggccgtcagcgtgagccccctgctgctcaccagctcccagcagaaggccgactggatccccctggccctgaccatcaagggcctcaaccccacggcgatcttcctgaccaccctgagccggacctccaagaagcgcagctggccgctcaacgaggccgtcatggccgtgggcatggtgtccatcctggccagcagcctgctcaagaacgacatccccatgacggggcccctggtcgccggcgggctgctcaccgtgtgctacgtgctgaccggccggtccgcggacctggagctcgagcgcgccgccgacgtcaagtgggaggaccaggccgagatcagcgggtccagccccatcctgtccatcaccatcagcgaggacggctccatgagcatcaagaacgaggaggaggagcacacgctgaccatcctcatccggaccggcctgctggtgatctccggggtgttcccggtcagcatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacacgatgtggcacgtcacccgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagaccaagcccggcctgttcaagaccaacacggggaccatcggcgcggtctccctcgacttcagccccggcacctccgggagccccatcgtggaccggaagggcaaggtggtcgggctgtacggcaacggcgtggtgacccgctccggggcctacgtcagcgccatcgcccagacggagaagtccatcgaggacaaccccgagatcgaggacgacatcttccggaagaagcgcctgaccatcatggacctccaccccggcgcggggaagaccaagcggtacctgcccgccatcgtgcgcgaggccatcaagcggggcctgcgcaccctgatcctcgccccgacgcgcgtggtcgccgcggagatggaggaggccctgcgggggctgcccatccgctaccagacccccgccatccgggccgagcacaccggccgcgagatcgtggacctcatgtgccacgccaccttcacgatgcggctgctgtcccccgtgcgcgtcccgaactacaacctcatcatcatggacgaggcgcacttcaccgaccccgccagcatcgccgcccggggctacatctccacccgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgaccgacttcaaggggaagaccgtctggttcgtgccgagcatcaaggccggcaacgacatcgcggcctgcctgcgcaagaacggcaagaaggtgatccagctgtcccggaagaccttcgacagcgagtacgtcaagacgcgcgccaacgactgggacttcgtggtgaccaccgacatctccgagatgggggccaacttccgggccgagcgcgtcatcgacccccggcgctgcatgaagcccgtgatcctcaccgacggcgaggagcgggtgatcctggcggggcccatgccggtcacgcacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccgcaagagcctgacgctcaacctgatcaccgagatggggcgcctgcccaccttcatgacccagaaggcccgggacgccctcgacaacctggccgtgctgcacacggccgaggtcggcgggcgcgcgtacaaccacgccctctccgagctgcccgagaccctggagaccctcctgctgctcaccctgctggccacggtgaccggcggcatcttcctcttcctgatgagcgggaagggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacgtacgtcgtgatcgccatcctgaccgtggtcgccgccaccatggcgaacgagatggggttcctggagaagaccaagaaggacctcggcctgggcagcatcacgacccaggagtccgagagcaacatcctggacatcgacctccgcccggcctccgcctggaccctgtacgccgtggccaccacgttcgtgacccccatgctgcggcacagcatcgagaactccagcgtcaacgtgtccctcaccgcgatcgccaaccaggccaccgtgctgatggggctgggccgcgggtggcccctcagcaagatggacatcggcgtccccctgctggccatcgggtgctactcccaggtgaacccgatcacgctcaccgcggccctgctgctcctggtggcccactacgccatcatcggccccggcctgcaggccaaggcgacccgcgaggcccagaagcggaccgccgccgggatcatgaagaaccccacggtcgacggcatcaccgtgatcgacctcgagcccatcccgtacgaccccaagttcgagaagcagctgggccaggtgatgctgctcgtcctgtgcgtgacccaggtgctgatgatgcgcaccacgtgggccctctgcgaggcgctgaccctggccaccggccccatcagcaccctctgggaggggaaccccggccggttctggaacacgaccatcgccgtctccatggccaacatcttccgcggcagctacctggccggggcgggcctcctcttctccatcatgaagaacaccaccaacacgcggcgcgggaccggcaacatcggcgagaccctgggggagaagtggaagtcccggctgaacgccctcggcaagtccgagttccagatctacaagaagtccgggatccaggaggtggaccgcaccctggccaaggagggcatcaagcgcggggagacggaccaccacgccgtgtcccgcggcagcgcgaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgaccaagggcgggcccgggcacgaggagcccatccccatgagcacctacggctggaacctcgtccggctgcagagcggggtggacgtgttcttcacgccgcccgagaagtgcgacaccctgctctgcgacatcggcgagtccagccccaaccccaccatcgaggccggccgcaccctgcgggtcctgaacctcgtggagaactggctgaacaacaacacccagttctgcgtgaaggtcctgaacccgtacatgccctccgtgatcgagaagatggagacgctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcaccatgaagcacaagaaggccacgtacgagccggacgtcgacctcggcagcgggacccgcaacatcggcatcgagaacgagatccccaacctggacatcatcggcaagcggatcgagaagatcaagcaggagcacgagacctcctggcactacgaccaggaccacccctacaagacctgggcgtaccacgggagctacgagacgaagcagaccggctccgccagctccatggtgaacggggtggtcaagctgctcaccaagccctgggacgtggtgccgatggtcacccagatggccatgacggacaccacccccttcggccagcagcgcgtgttcaaggagaaggtggacacccggacgcaggagcccaaggagggcaccaagaagctgatgcgcatcaccgccgagtggctgtggaaggagctcgggaagaagaagacgccccggatgtgcacgcgcgaggagttcacccggaaggtccgcagcaacgccgcgctgggcgccatcttcaccgacgagaacaagtggaagtccgcccgggaggccgtggaggacagccgcttctgggagctggtcgaccgggagcgcaacctccacctggaggggaagtgcgagacctgcgtgtacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtcagcaagaaggagggcggggccatgtacgcggacgacacggccgggtgggacacccgcatcaccctggaggacctcaagaacgaggagatggtgaccaaccacatgaagggcgagcacaagaagctggccgaggccatcttcaagctgacgtaccagaacaaggtggtccgggtgcagcgcccgacgccccgggggaccgtgatggacatcatctcccggaaggaccagcgcggcagcggccaggtcgtgacctacgggctcaacacgttcaccaacatggaggcccagctgatccggcagatggagggcgaggggatcttcaagtccatccagcgcctgaccgtgaccgaggagatcgcggtccagaactggctcgcccgggtgggccgcgagcggctgagccgcatggccatctccggcgacgactgcgtggtcaagcccctggacgaccggttcgccagcgccctcacggcgctgaacgacatggggaaggtgcgcaaggacatccagcagtgggagccctcccggggctggaacgactggacccaggtgccgttctgcagccaccacttccacgagctggtcatgaaggacgggcgcgtgctcgtggtcccctgccggaaccaggacgagctgatcggccgcgcccggatctcccagggggccggctggagcctgaaggagaccgcctgcctcggcaagtcctacgcccagatgtggaccctgatgtacttccaccgccgggacctgcgcctcgcggccaacgccatctgcagcgccgtgccctcccactgggtgcccaccagccggacgacctggtccatccacgccaagcacgagtggatgaccaccgaggacatgctggcggtctggaaccgcgtgtggatccaggagaacccgtggatggaggacaagacgcccgtggagagctgggaggaggtcccctacctggggaagcgcgaggaccagtggtgcggcagcctcatcgggctgacctcccgggccacctgggccaagaacatccagaccgccatcaaccaggtgcgcagcctgatcggcaacgaggagtacacggactacatgccctccatgaagcggttccgcaaggaggaggaggaggcgggggtgctctggtga

SEQ ID NO: 9437 - RNA, 9876 nt, synthetic construct
  misc_feature 1..9876: note = derived and/or modified CDS sequence (opt1) from DENV-2__EU687242__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatccgggggatcatgcaggccggcaagcgctccctgcggccgcagcccaccgagctcaagtacagctggaagacgtggggcaaggccaagatgctgtccaccgagagccacaaccagaccttcctgatcgacgggcccgagaccgcggagtgcccgaacacgaaccgcgcctggaactccctcgaggtcgaggactacggcttcggggtgttcagcaccaacatctggctgaagctgcgggagaagcaggacgtgttctgcgactccaagctcatgagcgccgccatcaaggacaaccgcgccgtccacgcggacatgggctactggatcgagtccgccctgaacgacacctggaagatggagaaggccagcttcatcgagatcaagtcctgctactggcccaagagccacaccctgtggtccaacggcgtgctcgagagcgagatgatcatccccaagaacttcgccgggcccgtgtcccagcacaactaccggccgggctaccacacccagacggccgggccctggcacctgggcaagctggagatggacttcgacttctgcgaggggaccaccgtcgtggtgaccgaggactgcggcaaccgcggccccagcctccggacgaccaccgcgagcgggaagctgatcaccgagtggtgctgccgctcctgcacgctgcccccgctccggtaccgcggcgaggacgggtgctggtacggcatggagatccggcccctgaaggagaaggaggagaacctggtcaacagcctcgtgaccgccgggcacggccagatcgacaacttctccctgggcgtgctggggatggccctcttcctggaggagatgctgcgcacccgggtcggcaccaagcacgccatcctcctggtggcggtgagcttcgtcacgctgatcaccgggaacatgtccttccgcgacctcggccgcgtgatggtgatggtcggggccaccatgaccgacgacatcggcatgggcgtgacgtacctggccctgctcgccgccttcaaggtgcggcccaccttcgcggccgggctgctgctccgcaagctgaccagcaaggagctgatgatggccaccatcggcatcgccctcctgtcccagagcacgatccccgagaccatcctggagctcaccgacgccctggcgctggggatgatggtcctcaagatcgtgcggaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccgcaccagcaagaagcggtcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccgcagcgcggacctggagctcgagcgggccgccgacgtcaagtgggaggaccaggccgagatctccgggagctcccccatcctgagcatcaccatctccgaggacggcagcatgtccatcaagaacgaggaggaggagcacaccctgacgatcctcatccgcaccggcctgctggtgatcagcggggtgttcccggtctccatccccatcaccgccgcggcctggtacctctgggaggtgaagaagcagcgggccggcgtgctgtgggacgtccccagcccgccgcccgtggggaaggccgagctggaggacggcgcctaccgcatcaagcagcgggggatcttcggctactcccagatcggcgcgggggtgtacaaggagggcaccttccacaccatgtggcacgtcacgcgcggggccgtgctcatgcaccggggcaagcgcatcgagcccagctgggccgacgtgaagaaggacctgatctcctacgggggcggctggaagctggagggggagtggaaggagggcgaggaggtccaggtgctcgccctggagcccgggaagaacccccgggccgtgcagaccaagcccggcctgttcaagaccaacaccgggacgatcggcgcggtcagcctcgacttctcccccggcaccagcgggtcccccatcgtggaccgcaagggcaaggtggtcgggctgtacggcaacggcgtggtgacccggagcggggcctacgtctccgccatcgcccagaccgagaagtccatcgaggacaaccccgagatcgaggacgacatcttccgcaagaagcggctgacgatcatggacctccaccccggcgcggggaagaccaagcgctacctgcccgccatcgtgcgggaggccatcaagcgcggcctgcgcaccctgatcctcgccccgacccgggtggtcgccgcggagatggaggaggccctgcgcgggctgcccatccggtaccagacgcccgccatccgcgccgagcacaccggccgggagatcgtggacctcatgtgccacgccaccttcaccatgcgcctgctgagccccgtgcgggtcccgaactacaacctcatcatcatggacgaggcgcacttcacggaccccgcctccatcgccgcccgcggctacatcagcacccgggtggagatgggggaggccgcgggcatcttcatgaccgccacgccgcccgggtcccgcgacccgttcccccagagcaacgcccccatcatggacgaggagcgggagatccccgagcgctcctggaacagcggccacgagtgggtgacggacttcaaggggaagaccgtctggttcgtgccgtccatcaaggccggcaacgacatcgcggcctgcctgcggaagaacggcaagaaggtgatccagctgagccgcaagaccttcgactccgagtacgtcaagacccgggccaacgactgggacttcgtggtgacgaccgacatcagcgagatgggggccaacttccgcgccgagcgggtcatcgacccccgccggtgcatgaagcccgtgatcctcaccgacggcgaggagcgcgtgatcctggcggggcccatgccggtcacccactccagcgccgcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgcgagaaggtggacgcgatcgacggggagtaccggctgcgcggcgaggcccggaagaccttcgtggacctcatgcgccgcggggacctgcccgtctggctggcctaccgcgtggccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctacagcgaccccctcgccctgaaggagttcaaggagttcgccgcgggccgcaagtccctgaccctcaacctgatcacggagatggggcggctgcccaccttcatgacccagaaggcccgcgacgccctcgacaacctggccgtgctgcacaccgccgaggtcggcgggcgggcgtacaaccacgccctcaacgagctgcccgagacgctggagaccctcctgctgctcaccctgctggccaccgtgacgggcggcatcttcctcttcctgatgagcgggaagggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacctacgtcgtgatcgccatcctgacggtggtcgccgccaccatggcgaacgagatggggttcctggagaagaccaagaaggacctcggcctgggctccatcaccacgcaggagagcgagagcaacatcctggacatcgacctccggccggcctccgcctggaccctgtacgccgtggccaccaccttcgtgacgcccatgctgcgccacagcatcgagaactccagcgtcaacgtgtccctcaccgcgatcgccaaccaggccaccgtgctgatggggctgggccgcgggtggcccctcagcaagatggacatcggcgtccccctgctggccatcgggtgctactcccaggtgaacccgatcaccctcacggcggccctgctgctcctggtggcccactacgccatcatcggccccggcctgcaggccaaggcgacccgggaggcccagaagcgcaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcggaccacctgggccctctgcgaggcgctgacgctggccaccggccccatcagcaccctctgggaggggaaccccggccgcttctggaacaccacgatcgccgtctccatggccaacatcttccggggcagctacctggccggggcgggcctcctcttctccatcatgaagaacaccaccaacacccgccgggggacgggcaacatcggcgagaccctgggggagaagtggaagtcccgcctgaacgccctcggcaagtccgagttccagatctacaagaagtccgggatccaggaggtggaccggaccctggccaaggagggcatcaagcgcggggagaccgaccaccacgccgtgtcccggggcagcgcgaagctgcgctggttcgtcgagcggaacatggtgacgccggagggcaaggtggtcgacctcgggtgcggccgcgggggctggtcctactactgcgggggcctgaagaacgtgcgggaggtgaagggcctgaccaagggcgggcccgggcacgaggagcccatccccatgagcacctacggctggaacctcgtccgcctgcagtccggggtggacgtgttcttcaccccgcccgagaagtgcgacacgctgctctgcgacatcggcgagagcagccccaaccccaccatcgaggccggccggaccctgcgcgtcctgaacctcgtggagaactggctgaacaacaacacccagttctgcgtgaaggtcctgaacccgtacatgccctccgtgatcgagaagatggagaccctccagcggaagtacgggggcgccctggtgcgcaaccccctgagccgcaactccacgcacgagatgtactgggtcagcaacgccaccgggaacatcgtgtccagcgtgaacatgatctcccggatgctgatcaaccgcttcaccatgaagcacaagaaggccacctacgagccggacgtcgacctcggcagcgggacgcggaacatcggcatcgagaacgagatccccaacctggacatcatcggcaagcgcatcgagaagatcaagcaggagcacgagacctcctggcactacgaccaggaccacccctacaagacctgggcgtaccacgggagctacgagaccaagcagacgggctccgccagctccatggtgaacggggtggtcaagctgctcaccaagccctgggacgtggtgccgatggtcacccagatggccatgaccgacacgacccccttcggccagcagcgggtgttcaaggagaaggtggacacccgcacccaggagcccaaggagggcacgaagaagctgatgcggatcaccgccgagtggctgtggaaggagctcgggaagaagaagacgccccgcatgtgcacccgggaggagttcacgcgcaaggtccggagcaacgccgcgctgggcgccatcttcaccgacgagaacaagtggaagtccgcccgcgaggccgtggaggacagccggttctgggagctggtcgaccgcgagcggaacctccacctggaggggaagtgcgagacctgcgtgtacaacatgatgggcaagcgcgagaagaagctgggggagttcggcaaggccaagggctcccgggcgatctggtacatgtggctcggggcccgcttcctggagttcgaggccctgggcttcctcaacgaggaccactggttcagccgggggaactccctgagcggcgtggagggggagggcctgcacaagctcggctacatcctgcgcgacgtcagcaagaaggagggcggggccatgtacgcggacgacaccgccgggtgggacacgcggatcaccctggaggacctcaagaacgaggagatggtgaccaaccacatgaagggcgagcacaagaagctggccgaggccatcttcaagctgacctaccagaacaaggtggtccgcgtgcagcgcccgacgccccgggggaccgtgatggacatcatctcccgcaaggaccagcggggcagcggccaggtcgggacctacggcctcaacaccttcacgaacatggaggcccagctgatccgccagatggagggggagggcatcttcaagtccatccagcggctgaccgtgaccgaggagatcgcggtgcagaactggctcgcccgcgtcggccgggagcgcctgagccggatggccatctccggggacgactgcgtggtgaagcccctggacgaccgcttcgccagcgccctcaccgcgctgaacgacatgggcaaggtccggaaggacatccagcagtgggagccctcccgcgggtggaacgactggacccaggtgccgttctgcagccaccacttccacgagctggtgatgaaggacggccgggtcctcgtggtgccctgccgcaaccaggacgagctgatcgggcgggcccgcatctcccagggcgccggctggagcctgaaggagaccgcctgcctcgggaagtcctacgcccagatgtggaccctgatgtacttccaccggcgcgacctgcggctcgcggccaacgccatctgcagcgccgtcccctcccactgggtgcccaccagccgcaccacgtggtccatccacgccaagcacgagtggatgaccaccgaggacatgctggcggtgtggaaccgcgtctggatccaggagaacccgtggatggaggacaagacccccgtggagagctgggaggaggtgccctacctgggcaagcgggaggaccagtggtgcgggtccctcatcggcctgacgagccgcgccacctgggccaagaacatccagaccgccatcaaccaggtccggagcctgatcgggaacgaggagtacaccgactacatgccctccatgaagcgcttccggaaggaggaggaggaggcgggcgtgctctggtga

SEQ ID NO: 9438 - RNA, 9876 nt, synthetic construct
  misc_feature 1..9876: note = derived and/or modified CDS sequence (opt1) from DENV-2__EU687243__SS-prME
  source 1..9876: mol_type = other RNA
accgccggggtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatccgggggatcatgcaggccggcaagcgctccctgcggccgcagcccaccgagctcaagtacagctggaagacgtggggcaaggccaagatgctgtccaccgagagccacaaccagaccttcctgatcgacgggcccgagaccgcggagtgcccgaacacgaaccgcgcctggaactccctcgaggtcgaggactacggcttcggggtgttcagcaccaacatctggctgaagctgcgggagaagcaggacgtgttctgcgactccaagctcatgagcgccgccatcaaggacaaccgcgccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccggccgggctaccacacccagacggccgggccctggcacctgggcaagctggagatggacttcgacttctgcgaggggaccaccgtcgtggtgaccgaggactgcggcaaccgcggccccagcctccggacgaccaccgcgagcgggaagctgatcaccgagtggtgctgccgctcctgcacgctgcccccgctccggtaccgcggcgaggacgggtgctggtacggcatggagatccggcccctgaaggagaaggaggagaacctggtcaacagcctcgtgaccgccgggcacggccagatcgacaacttctccctgggcgtgctggggatggccctcttcctggaggagatgctgcgcacccgggtcggcaccaagcacgccatcctcctggtggcggtgagcttcgtcacgctgatcaccgggaacatgtccttccgcgacctcggccgcgtgatggtgatggtcggggccaccatgaccgacgacatcggcatgggcgtgacgtacctggccctgctcgccgccttcaaggtgcggcccaccttcgcggccgggctgctgctccgcaagctgaccagcaaggagctgatgatggccaccatcggcatcgccctcctgtcccagagcacgatccccgagaccatcctggagctcaccgacgccctggcgctggggatgatggtcctcaagatcgtgcggaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccgcaccagcaagaagcggtcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccgcagcgcggacctggagctcgagcgggccgccgacgtcaagtgggaggaccaggccgagatctccgggagctcccccatcctgagcatcaccatctccgaggacggcagcatgtccatcaagaacgaggaggaggagcacaccctgacgatcctcatccgcaccggcctgctggtgatcagcggggtgttcccggtctccatccccatcaccgccgcggcctggtacctctgggaggtgaagaagcagcgggccggcgtgctgtgggacgtccccagcccgccgcccgtggggaaggccgagctggaggacggcgcctaccgcatcaagcagcgggggatcttcggctactcccagatcggcgcgggggtgtacaaggagggcaccttccacaccatgtggcacgtcacgcgcggggccgtgctcatgcaccggggcaagcgcatcgagcccagctgggccgacgtgaagaaggacctgatctcctacgggggcggctggaagctggagggggagtggaaggagggcgaggaggtccaggtgctcgccctggagcccgggaagaacccccgggccgtgcagaccaagcccggcctgttcaagaccaacaccgggacgatcggcgcggtcagcctcgacttctcccccggcaccagcgggtcccccatcgtggaccgcaagggcaaggtggtcgggctgtacggcaacggcgtggtgacccggagcggggcctacgtctccgccatcgcccagaccgagaagtccatcgaggacaaccccgagatcgaggacgacatcttccgcaagaagcggctgacgatcatggacctccaccccggcgcggggaagaccaagcgctacctgcccgccatcgtgcgggaggccatcaagcgcggcctgcgcaccctgatcctcgccccgacccgggtggtcgccgcggagatggaggaggccctgcgcgggctgcccatccggtaccagacgcccgccatccgcgccgagcacaccggccgggagatcgtggacctcatgtgccacgccaccttcaccatgcgcctgctgagccccgtgcgggtcccgaactacaacctcatcatcatggacgaggcgcacttcacggaccccgcctccatcgccgcccgcggctacatcagcacccgggtggagatgggggaggccgcgggcatcttcatgaccgccacgccgcccgggtcccgcgacccgttcccccagagcaacgcccccatcatggacgaggagcgggagatccccgagcgctcctggaacagcggccacgagtgggtgacggacttcaaggggaagaccgtctggttcgtgccgtccatcaaggccggcaacgacatcgcggcctgcctgcggaagaacggcaagaaggtgatccagctgagccgcaagaccttcgactccgagtacgtcaagacccgggccaacgactgggacttcgtggtgacgaccgacatcagcgagatgggggccaacttccgcgccgagcgggtcatcgacccccgccggtgcatgaagcccgtgatcctcaccgacggcgaggagcgcgtgatcctggcggggcccatgccggtcacccactccagcgccgcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgcgagaaggtggacgcgatcgacggggagtaccggctgcgcggcgaggcccggaagaccttcgtggacctcatgcgccgcggggacctgcccgtctggctggcctaccgcgtggccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctacagcgaccccctcgccctgaaggagttcaaggagttcgccgcgggccgcaagtccctgaccctcaacctgatcacggagatggggcggctgcccaccttcatgacccagaaggcccgcgacgccctcgacaacctggccgtgctgcacaccgccgaggtcggcgggcgggcgtacaaccacgccctcaacgagctgcccgagacgctggagaccctcctgctgctcaccctgctggccaccgtgacgggcggcatcttcctcttcctgatgagcgggaagggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacctacgtcgtgatcgccatcctgacggtggtcgccgccaccatggcgaacgagatggggttcctggagaagaccaagaaggacctcggcctgggctccatcaccacgcaggagagcgagagcaacatcctggacatcgacctccggccggcctccgcctggaccctgtacgccgtggccaccaccttcgtgacgcccatgctgcgccacagcatcgagaactccagcgtcaacgtgtccctcaccgcgatcgccaaccaggccaccgtgctgatggggctgggccgcgggtggcccctcagcaagatggacatcggcgtccccctgctggccatcgggtgctactcccaggtgaacccgatcaccctcacggcggccctgctgctcctggtggcccactacgccatcatcggccccggcctgcaggccaaggcgacccgggaggcccagaagcgcaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcggaccacctgggccctctgcgaggcgctgacgctggccaccggccccatcagcaccctctgggaggggaaccccggccgcttctggaacaccacgatcgccgtctccatggccaacatcttccggggcagctacctggccggggcgggcctcctcttctccatcatgaagaacaccaccaacacccgccgggggacgggcaacatcggcgagaccctgggggagaagtggaagtcccgcctgaacgccctcggcaagtccgagttccagatctacaagaagtccgggatccaggaggtggaccggaccctggccaaggagggcatcaagcgcggggagaccgaccaccacgccgtgtcccggggcagcgcgaagctgcgctggttcgtcgagcggaacatggtgacgccggagggcaaggtggtcgacctcgggtgcggccgcgggggctggtcctactactgcgggggcctgaagaacgtgcgggaggtgaagggcctgaccaagggcgggcccgggcacgaggagcccatccccatgagcacctacggctggaacctcgtccgcctgcagtccggggtggacgtgttcttcaccccgcccgagaagtgcgacacgctgctctgcgacatcggcgagagcagccccaaccccaccatcgaggccggccggaccctgcgcgtcctgaacctcgtggagaactggctgaacaacaacacccagttctgcgtgaaggtcctgaacccgtacatgccctccgtgatcgagaagatggagaccctccagcggaagtacgggggcgccctggtgcgcaaccccctgagccgcaactccacgcacgagatgtactgggtcagcaacgccaccgggaacatcgtgtccagcgtgaacatgatctcccggatgctgatcaaccgcttcaccatgaagcacaagaaggccacctacgagccggacgtcgacctcggcagcgggacgcggaacatcggcatcgagaacgagatccccaacctggacatcatcggcaagcgcatcgagaagatcaagcaggagcacgagacctcctggcactacgaccaggaccacccctacaagacctgggcgtaccacgggagctacgagaccaagcagacgggctccgccagctccatggtgaacggggtggtcaagctgctcaccaagccctgggacgtggtgccgatggtcacccagatggccatgaccgacacgacccccttcggccagcagcgggtgttcaaggagaaggtggacacccgcacccaggagcccaaggagggcacgaagaagctgatgcggatcaccgccgagtggctgtggaaggagctcgggaagaagaagacgccccgcatgtgcacccgggaggagttcacgcgcaaggtccggagcaacgccgcgctgggcgccatcttcaccgacgagaacaagtggaagtccgcccgcgaggccgtggaggacagccggttctgggagctggtcgaccgcgagcggaacctccacctggaggggaagtgcgagacctgcgtgtacaacatgatgggcaagcgcgagaagaagctgggggagttcggcaaggccaagggctcccgggcgatctggtacatgtggctcggggcccgcttcctggagttcgaggccctgggcttcctcaacgaggaccactggttcagccgggggaactccctgagcggcgtggagggggagggcctgcacaagctcggctacatcctgcgcgacgtcagcaagaaggagggcggggccatgtacgcggacgacaccgccgggtgggacacgcggatcaccctggaggacctcaagaacgaggagatggtgaccaaccacatgaagggcgagcacaagaagctggccgaggccatcttcaagctgacctaccagaacaaggtggtccgcgtgcagcgcccgacgccccgggggaccgtgatggacatcatctcccgcaaggaccagcggggcagcggccaggtcgggacctacggcctcaacaccttcacgaacatggaggcccagctgatccgccagatggagggggagggcatcttcaagtccatccagcggctgaccgtgaccgaggagatcgcggtgcagaactggctcgcccgcgtcggccgggagcgcctgagccggatggccatctccggggacgactgcgtggtgaagcccctggacgaccgcttcgccagcgccctcaccgcgctgaacgacatgggcaaggtccggaaggacatccagcagtgggagccctcccgcgggtggaacgactggacccaggtgccgttctgcagccaccacttccacgagctggtgatgaaggacggccgggtcctcgtggtgccctgccgcaaccaggacgagctgatcgggcgggcccgcatctcccagggcgccggctggagcctgaaggagaccgcctgcctcgggaagtcctacgcccagatgtggaccctgatgtacttccaccggcgcgacctgcggctcgcggccaacgccatctgcagcgccgtcccctcccactgggtgcccaccagccgcaccacgtggtccatccacgccaagcacgagtggatgaccaccgaggacatgctggcggtgtggaaccgcgtctggatccaggagaacccgtggatggaggacaagacccccgtggagagctgggaggaggtgccctacctgggcaagcgggaggaccagtggtgcgggtccctcatcggcctgacgagccgcgccacctgggccaagaacatccagaccgccatcaaccaggtccggagcctgatcgggaacgaggagtacaccgactacatgccctccatgaagcgcttccggaaggaggaggaggaggcgggcgtgctctggtga

SEQ ID NO: 9439 - RNA, 9876 nt, synthetic construct
  misc_feature 1..9876: note = derived and/or modified CDS sequence (opt1) from DENV-2__EU687245__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatcagcaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtgttcccggtctccatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctactcccagatcggcgcgggggtgtacaaggagggcaccttccacaccatgtggcacgtcacgcgcggggccgtgctcatgcaccgcggcaagcggatcgagcccagctgggccgacgtgaagaaggacctgatctcctacgggggcggctggaagctggagggggagtggaaggagggcgaggaggtccaggtgctcgccctggagcccgggaagaacccccgcgccgtgcagaccaagcccggcctgttcaagaccaacaccgggacgatcggcgcggtcagcctcgacttctcccccggcaccagcgggtcccccatcgtggaccggaagggcaaggtggtcgggctgtacggcaacggcgtggtgacccgcagcggggcctacgtctccgccatcgcccagaccgagaagtccatcgaggacaaccccgagatcgaggacgacatcttccggaagaagcgcctgacgatcatggacctccaccccggcgcggggaagaccaagcggtacctgcccgccatcgtgcgcgaggccatcaagcggggcctgcgcaccctgatcctcgccccgacccgcgtggtcgccgcggagatggaggaggccctgcgggggctgcccatccgctaccagacgcccgccatccgggccgagcacaccggccgcgagatcgtggacctcatgtgccacgccaccttcaccatgcggctgctgagccccgtgcgcgtcccgaactacaacctcatcatcatggacgaggcgcacttcacggaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtctggttcgtgccgtccatcaaggccggcaacgacatcgcggcctgcctgcgcaagaacggcaagaaggtgatccagctgagccggaagaccttcgactccgagtacgtcaagacccgcgccaacgactgggacttcgtggtgacgaccgacatcagcgagatgggggccaacttccgggccgagcgcgtcatcgacccccggcgctgcatgaagcccgtgatcctcaccgacggcgaggagcgggtgatcctggcggggcccatgccggtcacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaaggcccgggacgccctcgacaacctggccgtgctgcacaccgccgaggtcggcgggcgcgcgtacaaccacgccctcaacgagctgcccgagacgctggagaccctcctgctgctcaccctgctggccaccgtgacgggcggcatcttcctcttcctgatgagcgggaagggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgacggtggtcgccgccaccatggcgaacgagatggggttcctggagaagaccaagaaggacctcggcctgggctccatcaccacgcaggagagcgagagcaacatcctggacatcgacctccgcccggcctccgcctggaccctgtacgccgtggccaccaccttcgtgacgcccatgctgcggcacagcatcgagaactccagcgtcaacgtgtccctcaccgcgatcgccaaccaggccaccgtgctgatggggctgggccgcgggtggcccctcagcaagatggacatcggcgtccccctgctggccatcgggtgctactcccaggtgaacccgatcaccctcacggcggccctgctgctcctggtggcccactacgccatcatcggccccggcctgcaggccaaggcgacccgcgaggcccagaagcggaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgacgctggccaccggccccatcagcaccctctgggaggggaaccccggccggttctggaacaccacgatcgccgtctccatggccaacatcttccgcggcagctacctggccggggcgggcctcctcttctccatcatgaagaacaccaccaacgcccggcgcgggaccggcaacatcggcgagacgctgggggagaagtggaagtcccggctgaacgccctcggcaagtccgagttccagatctacaagaagtccgggatccaggaggtggaccgcaccctggccaaggagggcatcaagcgcggggagaccgaccaccacgcggtgtcccgcggcagcgccaagctgcggtggttcgtcgagcgcaacatggtgaccccggagggcaaggtggtcgacctcgggtgcggccgcggcgggtggtcctactactgcggcgggctgaagaacgtgcgcgaggtgaaggggctgacgaagggcgggcccgggcacgaggagcccatccccatgagcacctacggctggaacctcgtccggctgcagtccggggtggacgtgttcttcaccccgcccgagaagtgcgacaccctgctctgcgacatcggcgagagcagccccaaccccacgatcgaggccggccgcaccctgcgggtcctgaacctcgtggagaactggctgaacaacaacacccagttctgcgtgaaggtcctgaacccgtacatgccctccgtgatcgagaagatggagaccctccagcgcaagtacgggggcgccctggtgcggaaccccctgagccgcaactccacccacgagatgtactgggtcagcaacgccacggggaacatcgtgtccagcgtgaacatgatctcccgcatgctgatcaaccggttcaccatgaagcacaagaaggcgacctacgagccggacgtcgacctcggcagcgggacccgcaacatcggcatcgagaacgagatccccaacctggacatcatcggcaagcggatcgagaagatcaagcaggagcacgagacgtcctggcactacgaccaggaccacccctacaagacctgggcctaccacgggagctacgagaccaagcagaccggctccgccagctccatggtgaacggggtggtcaagctgctcacgaagccctgggacgtggtgccgatggtcacccagatggccatgaccgacaccacgcccttcggccagcagcgcgtgttcaaggagaaggtggacacccggacccaggagcccaaggagggcaccaagaagctgatgcgcatcacggccgagtggctgtggaaggagctcgggaagaagaagacgccccggatgtgcacccgcgaggagttcacccggaaggtccgcagcaacgcggccctgggcgccatcttcacggacgagaacaagtggaagtccgcccgggaggccgtggaggacagccgcttctgggagctggtcgaccgggagcgcaacctccacctggaggggaagtgcgagacctgcgtgtacaacatgatgggcaagcgggagaagaagctgggggagttcggcaaggcgaagggctcccgcgccatctggtacatgtggctcggggcccggttcctggagttcgaggccctgggcttcctcaacgaggaccactggttcagccgcgggaactccctgagcggcgtggagggggagggcctgcacaagctcggctacatcctgcgggacgtcagcaagaaggagggcggggcgatgtacgccgacgacaccgccgggtgggacacccgcatcacgctggaggacctcaagaacgaggagatggtgaccaaccacatgaagggcgagcacaagaagctggccgaggccatcttcaagctgacctaccagaacaaggtggtccgggtgcagcgcccgacctcccgcgggacggtgatggacatcatcagccggaaggaccagcgcggctccggccaggtcgggacctacggcctcaacaccttcaccaacatggaggcgcagctgatccggcagatggagggggagggcatcttcaagagcatccagcgcctgacggtgaccgaggagatcgccgtgcagaactggctcgcccgggtcggccgcgagcggctgtcccgcatggccatcagcggggacgactgcgtggtgaagcccctggacgaccggttcgcctccgcgctcaccgccctgaacgacatgggcaaggtccgcaaggacatccagcagtgggagcccagccgggggtggaacgactggacccaggtgcccttctgctcccaccacttccacgagctggtgatgaaggacggccgcgtcctcgtggtgccgtgccggaaccaggacgagctgatcgggcgcgcccggatcagccagggcgccggctggtccctgaaggagacggcctgcctcggcaagagctacgcgcagatgtggaccctgatgtacttccaccgccgggacctgcgcctcgccgccaacgccatctgctccgccgtccccagccactgggtgcccacctcccggaccacctggagcatccacgcgaagcacgagtggatgacgaccgaggacatgctggccgtgtggaaccgcgtctggatccaggagaacccctggatggaggacaagaccccggtggagtcctgggaggaggtgccctacctgggcaagcgcgaggaccagtggtgcgggagcctcatcggcctgaccagccgggccacgtgggccaagaacatccagaccgcggtcaaccaggtgcgctccctgatcgggaacgaggagtacaccgactacatgcccagcatgaagcggttccgcaaggaggaggaggaggccggcgtgctctggtga

SEQ ID NO: 9440 - RNA, 9873 nt, synthetic construct
  misc_feature 1..9873: note = derived and/or modified CDS sequence (opt1) from DENV-2__HQ541798__SS-prME
  source 1..9873: mol_type = other RNA
accgccggcatgatcttcatgctgatccccaccgtgatggccttccacctcaccacccggaacggggagccccacatgatcgtcagccggcaggagaagggcaagagcctgctgttcaagaccggggacggcgtgaacatgtgcaccctcatggcgatggacctgggggagctgtgcgaggacaccatcacctacaagtgccccctcctgcggcagaacgagcccgaggacatcgactgctggtgcaacagcacctccacctgggtgacctacgggacctgcaccaccaccggcgagcaccggcgcgagaagcggagcgtcgccctggtgccccacgtggggatgggcctcgagacccgcaccgagacctggatgtccagcgagggggcctggaagcacgcccagcggatcgagacctggatcctgcgccaccccggcttcaccatcatggccgcgatcctggcctacaccatcgggaccacccacttccagcgggccctcatcttcatcctgctgaccgccgtcgcgccctccatgaccatgcgctgcatcggcatcagcaaccgggacttcgtggagggcgtgtccgggggcagctgggtcgacatcgtgctcgagcacgggtcctgcgtgaccacgatggccaagaacaagcccaccctggacttcgagctgatcaagaccgaggccaagcagagcgccaccctccgcaagtactgcatcgaggccaagctgacgaacaccaccaccgagtcccggtgccccacgcagggcgagccgagcctgaacgaggagcaggacaagcgcttcgtctgcaagcactccatggtggaccggggctgggggaacggctgcggcctgttcggcaagggcgggatcgtgacctgcgcgatgttcacgtgcaagaaggacatgaagggcgaggtcgtgcagcccgagaacctggagtacaccatcgtgatcacgccccacagcggggaggagcacgccgtcggcaacgacaccgggaagcacggcaaggagatcaagatcacgccccagtccagcatcaccgaggccgagctgaccgggtacggcacggtgaccatggagtgctccccgcgcaccggcctcgacttcaacgagatggtgctgctgcagatggagaacaaggcctggctcgtccaccggcagtggttcctggacctgcccctcccctggctgcccggggccgacacccagggcagcaactggatccagaaggagacgctggtgaccttcaagaacccgcacgcgaagaagcaggacgtggtcgtgctcgggagccaggagggcgccatgcacaccgccctgaccggggccacggagatccagatgtccagcggcaacctcctcttcaccggccacctgaagtgccgcctgcggatggacaagctccagctgaaggggatgtcctacagcatgtgcaccggcaagttcaaggtcgtgaaggagatcgccgagacccagcacgggacgatcgtgatccgcgtccagtacgagggcgacggctccccctgcaagatccccttcgagatcatggacctggagaagcggcacgtgctcgggcgcctgatcaccgtgaaccccatcgtcaccgagaaggacagcccggtgaacatcgaggcggagccgcccttcggcgactcctacatcatcatcggggtggagcccggccagctgaagctcaactggttcaagaaggggagctccatcggccagatgctggagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgactccggctgcgtggtcagctggaagaacaaggagctgaagtgcggcagcgggatcttcatcaccgacaacgtgcacacgtggaccgagcagtacaagttccagccggagtcccccagcaagctggcgtccgccatccagaaggcccacgaggagggcatctgcgggatccggagcgtgacccgcctcgagaacctgatgtggaagcagatcacccccgagctgaaccacatcctctccgagaacgaggtcaagctgacgatcatgaccggcgacatcaaggggatcatgcaggccggcaagcggagcctgcgcccccagccgaccgagctcaagtactcctggaagacctggggcaaggccaagatgctgagcacggagtcccacaaccagaccttcctgatcgacgggcccgagaccgcggagtgccccaacaccaaccgggcctggaacagcctcgaggtggaggactacggcttcggggtgttcacgaccaacatctggctgaagctgcgcgagaagcaggacgtcttctgcgactccaagctcatgagcgccgccatcaaggacaaccgggccgtgcacgcggacatgggctactggatcgagtccgccctgaacgacacctggaagatcgagaaggccagcttcatcgaggtgaagtcctgccactggccgaagccccacaccctgtggagcaacgaggtcctcgagtccgagatgatcatccccaagaacttcgccggccccgtgagccagcacaactaccgcccggggtaccacacccagacggccggcccctggcacctggggaagctggagatggacttcgacttctgcgagggcaccaccgtggtcgtgaccgaggactgcgggaaccggggccccagcctccgcacgaccaccgcgtccggcaagctgatcaccgagtggtgctgccggagctgcacgctgcccccgctccgctaccgcggggaggacggctgctggtacgggatggagatccgccccctgaaggagaaggaggagaacctggtgaactccctcgtcaccgccggccacgggcagatcgacaacttcagcctgggcgtgctgggcatggccctcttcctggaggagatgctgcggacccgcgtggggaccaagcacgccatcctcctggtcgcggtgtccttcgtgacgctgatcaccggcaacatgagcttccgggacctcgggcgcgtcatggtgatggtgggcgccaccatgaccgacgacatcgggatgggcgtcacgtacctggccctgctcgccgccttcaaggtgcgccccaccttcgcggccggcctgctgctccggaagctgacctccaaggagctgatgatgaccacgatcgggatcgtgctcctgagccagtccaccatccccgagaccatcctggagctcaccgacgccctggccctgggcatgatggtcctcaagatggtgcgcaagatggagaagtaccagctggccgtgacgatcatggcgatcctgtgcgtcccgaacgccgtgatcctccagaacgcctggaaggtcagctgcaccatcctggccgtggtgtccgtcagccccctgttcctcacctccagccagcagaaggccgactggatccccctggcgctgaccatcaaggggctcaaccccacggccatcttcctgaccaccctgtcccggaccaacaagaagcgcagctggccgctcaacgaggccatcatggccgtgggcatggtgtccatcctggcgagctccctgctcaagaacgacatccccatgacgggccccctggtcgccgggggcctgctcaccgtgtgctacgtgctgaccgggcggagcgccgacctggagctcgagcgcgccgccgacgtcaagtgggaggaccaggcggagatcagcggctccagccccatcctgtccatcaccatcagcgaggacgggtccatgagcatcaagaacgaggaggaggagcagacgctgaccatcctcatccggaccggcctgctggtgatctccggcctcttcccggtgagcctgcccatcaccgccgccgcctggtacctgtgggaggtcaagaagcagcgcgccggggtgctctgggacgtgcccagcccgccgcccgtcggcaaggcggagctggaggacggggcctaccggatcaagcagaagggcatcctggggtacagccagatcggcgccggcgtgtacaaggaggggaccttccacacgatgtggcacgtgacccgcggcgccgtcctcatgcacaaggggaagcggatcgagccctcctgggccgacgtgaagaaggacctgatcagctacggcgggggctggaagctggagggcgagtggaaggagggggaggaggtgcaggtcctcgcgctggagcccggcaagaacccccgcgccgtgcagaccaagcccgggctgttcaagaccaacgccggcacgatcggggccgtgtccctcgacttcagccccggcacctccggcagccccatcatcgacaagaaggggaaggtcgtgggcctgtacgggaacggcgtggtcacccggtccggcgcctacgtgagcgcgatcgcccagaccgagaagtccatcgaggacaaccccgagatcgaggacgacatcttccgcaagcggaagctgacgatcatggacctgcaccccggggccggcaagaccaagcgctacctccccgccatcgtgcgggaggcgatcaagcgcgggctgcggaccctgatcctcgccccgacccgcgtcgtggccgccgagatggaggaggccctgcggggcctgcccatccgctaccagacgcccgcgatccgcgccgagcacaccgggcgggagatcgtggacctcatgtgccacgccaccttcaccatgcgcctgctgagccccgtccgggtgccgaactacaacctcatcatcatggacgaggcccacttcacggaccccgccagcatcgcggcccgcggctacatctccacccgggtggagatgggcgaggccgccgggatcttcatgaccgccacgccgcccggcagccgcgacccgttcccccagtccaacgcgcccatcatggacgaggagcgggagatccccgagcgcagctggtccagcgggcacgagtgggtcacggacttcaagggcaagaccgtgtggttcgtgccgtccatcaaggccgggaacgacatcgccgcctgcctgcggaagaacggcaagaaggtcatccagctgagccgcaagaccttcgactccgagtacgtgaagacccggacgaacgactgggacttcgtggtcaccaccgacatcagcgagatgggcgcgaacttcaaggccgagcgcgtgatcgacccccggcgctgcatgaagcccgtgatcctcaccgacggggaggagcgggtcatcctggccggccccatgccggtgacgcactccagcgccgcccagcgccgggggcgcatcggccggaaccccaagaacgagaacgaccagtacatctacatgggggagcccctggagaacgacgaggactgcgcgcactggaaggaggccaagatgctcctggacaacatcaacacccccgagggcatcatcccgtccatgttcgagcccgagcgcgagaaggtggacgccatcgacggcgagtaccgcctgcgcggggaggcccgcaagaccttcgtcgacctcatgcggcgcggcgacctgcccgtgtggctggcctaccgggtggcggccgaggggatcaactacgccgaccgccggtggtgcttcgacggcatcaagaacaaccagatcctcgaggagaacgtcgaggtggagatctggaccaaggagggggagcgcaagaagctgaagccgcggtggctggacgcccgcatctacagcgaccccctcgccctgaaggagttcaaggagttcgcggccggccggaagtccctgacgctcagcctgatcaccgagatgggccgcctgcccaccttcatgacccagaaggcccgggacgccctcgacaacctggcggtcctgcacacggccgaggccgggggccgcgcctacaaccacgccctctccgagctgcccgagaccctggagaccctcctgctgctcaccctgctggcgacggtgaccgggggcatcttcctcttcctgatgagcggccgggggatcggcaagatgaccctggggatgtgctgcatcatcaccgcctccatcctcctgtggtacgcccagatccagccgcactggatcgccgccagcatcatcctggagttcttcctcatcgtgctgctgatccccgagcccgagaagcagcgcacgccccaggacaaccagctcacgtacgtcgtgatcgcgatcctgaccgtggtcgccgccaccatggccaacgagatgggcttcctggagaagaccaagaaggacctcgggctgggcagcatcacgacccagcagccggagtccaacatcctggacatcgacctccggcccgccagcgcgtggaccctgtacgccgtggccaccacgttcgtgacccccatgctgcgccactccatcgagaacagctccgtcaacgtgagcctcaccgccatcgccaaccaggcgaccgtgctgatgggcctggggaagggctggcccctctccaagatggacatcggggtcccgctgctggccatcggctgctacagccaggtgaaccccatcacgctcaccgccgccctgttcctgctcgtggcgcactacgccatcatcgggcccggcctgcaggccaaggccacccgggaggcccagaagcgcgcggccgccggcatcatgaagaaccccaccgtcgacgggatcacggtgatcgacctggacccgatcccctacgaccccaagttcgagaagcagctcggccaggtgatgctgctggtcctctgcgtgacccaggtgctgatgatgcggaccacctgggccctgtgcgaggccctcacgctggcgaccgggcccatctccaccctgtgggagggcaacccggggcgcttctggaacaccacgatcgccgtcagcatggccaacatcttccgcggctcctacctcgccggcgccgggctgctgttcagcatcatgaagaacaccaccaacacccggcgcggcacggggaacatcggcgagaccctcggcgagaagtggaagtcccggctgaacgcgctggggaagtccgagttccagatctacaagaagtccggcatccaggaggtggaccgcaccctcgccaaggaggggatcaagcggggcgagaccgaccaccacgccgtgagccgcgggtccgccaagctgcggtggttcgtcgagcgcaacatggtgacgcccgagggcaaggtggtcgacctgggctgcgggcggggcgggtggagctactactgcggcgggctcaagaacgtgcgcgaggtgaagggcctgaccaagggcgggcccggccacgaggagcccatcccgatgtccacctacgggtggaacctggtccggctccagagcggcgtggacgtgttcttcacgccgcccgagaagtgcgacacgctgctgtgcgacatcggggagagctcccccaacccgaccgtcgaggcgggccgcaccctccgggtgctgaacctggtggagaactggctcaacaacaacacccagttctgcatcaaggtcctgaacccctacatgcccagcgtgatcgagaagatggaggccctgcagcgcaagtacggcggggccctggtgcggaacccgctctcccgcaacagcacccacgagatgtactgggtctccaacgccagcggcaacatcgtgtccagcgtgaacatgatctcccggatgctgatcaaccgcttcacgatgcggcacaagaaggccacctacgagcccgacgtcgacctggggagcggcacccgcaacatcgggatcgagtccgagatccccaacctcgacatcatcggcaagcgcatcaagatcaagcaggagcacgagaccagctggcactacgaccaggaccacccctacaagacgtgggcgtaccacggctcctacgagaccaagcagaccgggagcgcctccagcatggtgaacggcgtggtccggctgctgaccaagccgtgggacgtggtgcccatggtcacgcagatggccatgaccgacaccacccccttcgggcagcagcgcgtgttcaaggagaaggtggacacgcggacccaggagcccaaggagggcaccaagaagctcatgaagatcaccgccgagtggctgtggaaggagctgggcaagaagaagacgccgcgcatgtgcacccgggaggagttcacccgcaaggtccggtccaacgccgcgctcggggccatcttcaccgacgagaacaagtggaagtccgcccgcgaggccgtggaggactcccggttctgggagctggtcgacaaggagcgcaacctgcacctcgagggcaagtgcgagacgtgcgtgtacaacatgatggggaagcgggagaagaagctgggcgagttcgggaaggccaagggcagccgcgcgatctggtacatgtggctgggcgcccggttcctcgagttcgaggccctggggttcctgaacgaggaccactggttcagccgcgagaactccctcagcggcgtggagggggagggcctgcacaagctggggtacatcctccgggacgtctccaagaaggagggcggcgccatgtacgcggacgacaccgccgggtgggacacccgcatcaccctggaggacctgaagaacgaggagatggtgacgaaccacatggagggcgagcacaagaagctcgccgaggccatcttcaagctgacctaccagaacaaggtggtccgggtgcagcgccccacgccccgggggaccgtgatggacatcatcagccgccgggaccagcgcggctccgggcaggtcggcacgtacggcctgaacaccttcaccaacatggaggcccagctcatccgccagatggagggggagggcgtgttcaagagcatccagcacctgaccgtgacggaggagatcgcggtccagaactggctggcccgggtggggcgcgagcggctctcccgcatggccatcagcggcgacgactgcgtggtcaagcccctggacgaccggttcgcctccgccctgaccgcgctcaacgacatgggcaaggtgcgcaaggacatccagcagtgggagccgagccgggggtggaacgactggacccaggtgcccttctgctcccaccacttccacgagctgatcatgaaggacggccgcgtcctggtggtgccctgccggaaccaggacgagctcatcgggcgcgcccggatcagccagggcgccgggtggtccctgcgcgagaccgcctgcctgggcaagagctacgcccagatgtggtccctcatgtacttccaccggcgcgacctgcggctggcggccaacgccatctgcagcgccgtcccctcccactgggtgccgacgagccgcaccacctggagcatccacgccaagcacgagtggatgaccgcggaggacatgctcaccgtgtggaaccgggtctggatccaggagaacccctggatggaggacaagacgcccgtggagtcctgggaggagatcccctacctgggcaagcgcgaggaccagtggtgcgggagcctgatcggcctcacctcccgggccacctgggccaagaacatccagaccgccatcaaccaggtgcgcagcctgatcgggaacgaggagtacacggactacatgccgtccatgaagcgcttccggcgcgaggaggaggaggcgggcgtcctgtggtga

SEQ ID NO: 9441 - RNA, 9876 nt, synthetic construct
  misc_feature 1..9876: note = derived and/or modified CDS sequence (opt1) from DENV-2__JF730053__SS-prME
  source 1..9876: mol_type = other RNA
accgccggcatgatcatcatgctgatccccaccgtgatggccttccacctcaccacccggaacggggagccccacatgatcgtcagccggcaggagaagggcaagagcctgctgttcaagaccggggacggcgtgaacatgtgcaccctcatggcgatggacctgggggagctgtgcgaggacaccatcacctacaagtgccccctcctgcggcagaacgagcccgaggacatcgactgctggtgcaacagcaccagcacctgggtgacctacgggacctgcaccaccaccggcgagcaccggcgggagaagcggagcgtcgccctggtgccccacgtggggatgggcctcgagacccgcaccgagacctggatgagcagcgagggggcctggaagcacgcccagcggatcgagacgtggatcctgcgccaccccggcttcaccatcatggccgcgatcctggcctacaccatcgggaccacgcacttccagcgggccctcatcttcatcctgctgaccgccgtcgcgcccagcatgaccatgcgctgcatcggcatcagcaaccgggacttcgtggagggcgtgtccgggggcagctgggtcgacatcgtgctcgagcacgggtcctgcgtgaccacgatggccaagaacaagcccaccctggacttcgagctgatcaagaccgaggccaagcagagcgccaccctccgcaagtactgcatcgaggccaagctgacgaacaccaccaccgagtcccggtgccccacgcagggcgagcccagcctgaacgaggagcaggacaagcgcttcgtctgcaagcactccatggtggaccggggctgggggaacggctgcggcctgttcggcaagggcgggatcgtgacctgcgcgatgttcacgtgcaagaagaacatgaagggcaaggtcgtgcagcccgagaacctggagtacaccatcgtgatcacgccccacagcggggaggagcacgccgtcggcaacgacaccgggaagcacggcaaggagatcaagatcacgccccagtccagcatcaccgaggccgagctgaccgggtacggcacggtgaccatggagtgctccccgcgcaccggcctcgacttcaacgagatggtgctgctgcagatggagaacaaggcctggctcgtccaccggcagtggttcctggacctgcccctcccctggctgcccggggccgacacccagggcagcaactggatccagaaggagacgctggtgaccttcaagaacccgcacgcgaagaagcaggacgtggtcgtgctcgggagccaggagggcgccatgcacaccgccctgaccggggccacggagatccagatgtccagcggcaacctcctcttcaccggccacctgaagtgccgcctgcggatggacaagctccagctgaaggggatgtcctacagcatgtgcaccggcaagttcaaggtcgtgaaggagatcgccgagacccagcacgggacgatcgtgatccgcgtccagtacgagggcgacggctccccctgcaagatccccttcgagatcatggacctggagaagcggcacgtgctcgggcgcctgatcaccgtgaaccccatcgtcaccgagaaggacagcccggtgaacatcgaggcggagccgcccttcggcgactcctacatcatcatcggggtggagcccggccagctgaagctcaactggttcaagaaggggagctccatcggccagatgctggagaccacgatgcgcggcgccaagcggatggccatcctgggggacaccgcctgggacttcggcagcctcgggggcgtcttcacctccatcgggaaggccctgcaccaggtgttcggcgcgatctacggcgccgccttcagcggggtgtcctggaccatgaagatcctgatcggcgtcatcatcacgtggatcgggatgaacagccgctccaccagcctgtccgtgagcctcgtgctggtcggcgtggtgaccctgtacctcggggtcatggtgcaggccgactccggctgcgtggtcagctggaagaacaaggagctgaagtgcggcagcgggatcttcatcaccgacaacgtgcacacgtggaccgagcagtacaagttccagccggagtcccccagcaagctggcgtccgccatccagaaggcccacgaggagggcatctgcgggatccggagcgtgacccgcctcgagaacctgatgtggaagcagatcacccccgagctgaaccacatcctctccgagaacgaggtcaagctgacgatcatgaccggcgacatcaaggggatcatgcaggccggcaagcggagcctgcgcccccagccgaccgagctcaagtactcctggaagacctggggcaaggccaagatgctgagcacggagtcccacaaccagaccttcctgatcgacgggcccgagaccgcggagtgccccaacaccaaccgggcctggaacagcctcgaggtggaggactacggcttcggggtgttcacgaccaacatctggctgaagctgcgcgagaagcaggacgtcttctgcgactccaagctcatgagcgccgccatcaaggacaaccgggccgtgcacgcggacatgggctactggatcgagtccgccctgaacgacacctggaagatcgagaaggccagcttcatcgaggtgaagtcctgccactggcccaagagccacaccctgtggtccaacgaggtcctcgagagcgagatgatcatccccaagaacttcgccggccccgtgagccagcacaactaccgccccgggtaccacacccagacggccggcccgtggcacctggggaagctggagatggacttcgacttctgcgagggcaccaccgtggtcgtgaccgaggactgcgggaaccggggcccctccctccgcacgaccaccgcgagcggcaagctgatcaccgagtggtgctgccggtcctgcacgctgccgcccctccgctaccgcggggaggacggctgctggtacgggatggagatccgcccgctgaaggagaaggaggagaacctggtgaacagcctcgtcaccgccggccacgggcagatcgacaacttctccctgggcgtgctgggcatggccctcttcctggaggagatgctgcggacccgcgtggggaccaagcacgccatcctcctggtcgcggtgagcttcgtgacgctgatcaccggcaacatgtccttccgggacctcgggcgcgtcatggtgatggtgggcgccaccatgaccgacgacatcgggatgggcgtcacgtacctggccctgctcgccgccttcaaggtgcgccccaccttcgcggccggcctgctgctccggaagctgaccagcaaggagctgatgatgaccacgatcgggatcgtgctcctgtcccagagcaccatccccgagaccatcctggagctcaccgacgccctggccctgggcatgatggtcctcaagatggtgcgcaagatggagaagtaccagctggccgtgacgatcatggcgatcctgtgcgtccccaacgccgtgatcctccagaacgcctggaaggtctcctgcaccatcctggccgtggtgagcgtctccccgctgttcctcaccagctcccagcagaaggccgactggatccccctggcgctgaccatcaaggggctcaaccccacggccatcttcctgaccaccctgagccggaccaacaagaagcgctcctggcccctcaacgaggccatcatggccgtgggcatggtgagcatcctggcgtccagcctgctcaagaacgacatcccgatgacgggccccctggtcgccgggggcctgctcaccgtgtgctacgtgctgaccgggcggagcgccgacctggagctcgagcgcgccgccgacgtcaagtgggaggaccaggcggagatctccggcagctcccccatcctgagcatcaccatctccgaggacgggagcatgtccatcaagaacgaggaggaggagcagacgctgaccatcctcatccggaccggcctgctggtgatcagcggcctcttccccgtgtccctgccgatcaccgccgccgcctggtacctgtgggaggtcaagaagcagcgcgccggggtgctctgggacgtgccctccccgccgcccgtcggcaaggcggagctggaggacggggcctaccggatcaagcagaagggcatcctggggtactcccagatcggcgccggcgtgtacaaggaggggaccttccacacgatgtggcacgtgacccgcggcgccgtcctcatgcacaaggggaagcggatcgagcccagctgggccgacgtgaagaaggacctgatctcctacggcgggggctggaagctggagggcgagtggaaggagggggaggaggtgcaggtcctcgcgctggagcccggcaagaacccgcgcgccgtgcagaccaagcccgggctgttcaagaccaacgccggcacgatcggggccgtgagcctcgacttctcccccggcaccagcggctcccccatcatcgacaagaaggggaaggtcgtgggcctgtacgggaacggcgtggtcacccggagcggcgcctacgtgtccgcgatcgcccagaccgagaagtccatcgaggacaacccggagatcgaggacgacatcttccgcaagcggaagctgacgatcatggacctgcaccccggggccggcaagaccaagcgctacctccccgccatcgtgcgggaggcgatcaagcgcgggctgcggaccctgatcctcgcccccacccgcgtcgtggccgccgagatggaggaggccctgcggggcctgccgatccgctaccagacgcccgcgatccgcgccgagcacaccgggcgggagatcgtggacctcatgtgccacgccaccttcaccatgcgcctgctgagccccgtccgggtgcccaactacaacctcatcatcatggacgaggcccacttcacggacccggcctccatcgcggcccgcggctacatcagcacccgggtggagatgggcgaggccgccgggatcttcatgaccgccacgccgcccggctcccgcgaccccttcccgcagagcaacgcgcccatcatggacgaggagcgggagatccccgagcgctcctggagctccgggcacgagtgggtcacggacttcaagggcaagaccgtgtggttcgtgcccagcatcaaggccgggaacgacatcgccgcctgcctgcggaagaacggcaagaaggtcatccagctgtcccgcaagaccttcgacagcgagtacgtgaagacccggacgaacgactgggacttcgtggtcaccaccgacatctccgagatgggcgcgaacttcaaggccgagcgcgtgatcgacccgcggcgctgcatgaagcccgtgatcctcaccgacggggaggagcgggtcatcctggccggccccatgcccgtgacgcacagctccgccgcccagcgccgggggcgcatcggccggaacccgaagaacgagaacgaccagtacatctacatgggggagcccctggagaacgacgaggactgcgcgcactggaaggaggccaagatgctcctggacaacatcaacacccccgagggcatcatccccagcatgttcgagccggagcgcgagaaggtggacgccatcgacggcgagtaccgcctgcgcggggaggcccgcaagaccttcgtcgacctcatgcggcgcggcgacctgcccgtgtggctggcctaccgggtggcggccgaggggatcaactacgccgaccgccggtggtgcttcgacggcatcaagaacaaccagatcctcgaggagaacgtcgaggtggagatctggaccaaggagggggagcgcaagaagctgaagccccggtggctggacgcccgcatctactccgacccgctcgccctgaaggagttcaaggagttcgcggccggccgcaagagcctgacgctctccctgatcaccgagatgggccgcctgcccaccttcatgacccagaaggcccgggacgccctcgacaacctggcggtcctgcacacggccgaggccgggggccgcgcctacaaccacgccctcagcgagctgcccgagaccctggagaccctcctgctgctcaccctgctggcgacggtgaccgggggcatcttcctcttcctgatgtccggccgggggatcggcaagatgaccctggggatgtgctgcatcatcaccgccagcatcctcctgtggtacgcccagatccagccccactggatcgccgccagcatcatcctggagttcttcctcatcgtgctgctgatcccggagcccgagaagcagcgcacgccccaggacaaccagctcacgtacgtcgtgatcgcgatcctgaccgtggtcgccgccaccatggccaacgagatgggcttcctggagaagaccaagaaggacctcgggctgggctccatcacgacccagcagcccgagagcaacatcctggacatcgacctccggccggcctccgcgtggaccctgtacgccgtggccaccacgttcgtgacccccatgctgcgccacagcatcgagaactccagcgtcaacgtgtccctcaccgccatcgccaaccaggcgaccgtgctgatgggcctggggaagggctggcccctcagcaagatggacatcggggtccccctgctggccatcggctgctactcccaggtgaacccgatcacgctcaccgccgccctgttcctgctcgtggcgcactacgccatcatcgggcccggcctgcaggccaaggccacccgggaggcccagaagcgcgcggccgccggcatcatgaagaaccccaccgtcgacgggatcacggtgatcgacctggaccccatcccgtacgaccccaagttcgagaagcagctcggccaggtgatgctgctggtcctctgcgtgacccaggtgctgatgatgcggaccacctgggccctgtgcgaggccctcacgctggcgaccgggcccatcagcaccctgtgggagggcaaccccgggcgcttctggaacaccacgatcgccgtctccatggccaacatcttccgcggcagctacctcgccggcgccgggctgctgttctccatcatgaagaacaccaccaacacccggcgcggcacggggaacatcggcgagaccctcggcgagaagtggaagtcccggctgaacgcgctggggaagtccgagttccagatctacaagaagtccggcatccaggaggtggaccgcaccctcgccaaggaggggatcaagcggggcgagaccgaccaccacgccgtgtcccgcgggagcgccaagctgcggtggttcgtcgagcgcaacatggtgacgccggagggcaaggtggtcgacctgggctgcgggcggggcgggtggtcctactactgcggcgggctcaagaacgtgcgcgaggtgaagggcctgaccaagggcgggcccggccacgaggagcccatccccatgagcacctacgggtggaacctggtccggctccagagcggcgtggacgtgttcttcaccccgcccgagaagtgcgacacgctgctgtgcgacatcggggagtccagccccaaccccaccgtcgaggcgggccgcaccctccgggtgctgaacctggtggagaactggctcaacaacaacacccagttctgcatcaaggtcctgaacccgtacatgccctccgtgatcgagaagatggaggccctgcagcgcaagtacggcggggccctggtgcggaaccccctcagccgcaactccacccacgagatgtactgggtcagcaacgcctccggcaacatcgtgagctccgtgaacatgatcagccggatgctgatcaaccgcttcacgatgcggcacaagaaggccacctacgagccggacgtcgacctggggtccggcacccgcaacatcgggatcgagagcgagatccccaacctcgacatcatcggcaagcgcatcgagaagatcaagcaggagcacgagacctcctggcactacgaccaggaccacccctacaagacgtgggcgtaccacggcagctacgagaccaagcagaccgggtccgccagctccatggtgaacggcgtggtccggctgctgaccaagccctgggacgtggtgccgatggtcacgcagatggccatgaccgacaccacccccttcgggcagcagcgcgtgttcaaggagaaggtggacacgcggacccaggagcccaaggagggcaccaagaagctcatgaagatcaccgccgagtggctgtggaaggagctgggcaagaagaagacgccccgcatgtgcacccgggaggagttcacccgcaaggtccggagcaacgccgcgctcggggccatcttcaccgacgagaacaagtggaagtccgcccgcgaggccgtggaggacagccggttctgggagctggtcgacaaggagcgcaacctgcacctcgagggcaagtgcgagacgtgcgtgtacaacatgatggggaagcgggagaagaagctgggcgagttcgggaaggccaagggcagccgcgcgatctggtacatgtggctgggcgcccggttcctcgagttcgaggccctggggttcctgaacgaggaccactggttctcccgcgagaacagcctctccggcgtggagggggagggcctgcacaagctggggtacatcctccgggacgtcagcaagaaggagggcggcgccatgtacgcggacgacaccgccgggtgggacacccgcatcaccctggaggacctgaagaacgaggagatggtgacgaaccacatggagggcgagcacaagaagctcgccgaggccatcttcaagctgacctaccagaacaaggtggtccgggtgcagcgcccgacgccccgggggaccgtgatggacatcatctcccgccgggaccagcgcggcagcgggcaggtcggcacctacggcctgaacaccttcaccaacatggaggcccagctcatccgccagatggagggggagggcgtgttcaagtccatccagcacctgaccgtgacggaggagatcgcggtccagaactggctggcccgggtggggcgcgagcggctcagccgcatggccatctccggcgacgactgcgtggtcaagcccctggacgaccggttcgccagcgccctgaccgcgctcaacgacatgggcaaggtgcgcaaggacatccagcagtgggagccctcccgggggtggaacgactggacccaggtgccgttctgcagccaccacttccacgagctgatcatgaaggacggccgcgtcctggtggtgccctgccggaaccaggacgagctcatcgggcgcgcccggatctcccagggcgccgggtggagcctgcgcgagaccgcctgcctgggcaagtcctacgcccagatgtggagcctcatgtacttccaccggcgcgacctgcggctggcggccaacgccatctgctccgccgtccccagccactgggtgcccacgagccgcaccacctggtccatccacgccaagcacgagtggatgaccgcggaggacatgctcaccgtgtggaaccgggtctggatccaggagaacccgtggatggaggacaagacgcccgtggagagctgggaggagatcccctacctgggcaagcgcgaggaccagtggtgcgggtccctgatcggcctcaccagccgggccacctgggccaagaacatccagaccgccatcaaccaggtgcgctccctgatcgggaacgaggagtacacggactacatgcccagcatgaagcgcttccggcgcgaggaggaggaggcgggcgtcctgtggtga

SEQ ID NO: 9442 - RNA, 9876 nt, synthetic construct
  misc_feature 1..9876: note = derived and/or modified CDS sequence (opt1) from DENV-2__EU529706__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccatcatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacaccatcgtgatcacgccccacagcggggaggagcacgccgtcggcaacgacaccgggaagcacggcaaggagatcaagatcaccccgcagtccagcatcaccgaggccgagctgaccgggtacggcacggtgaccatggagtgcagcccccggaccggcctcgacttcaacgagatggtgctgctgcagatggaggacaaggcctggctcgtccaccggcagtggttcctggacctgcccctcccctggctgccgggggccgacacccagggcagcaactggatccagaaggagacgctggtgaccttcaagaacccccacgcgaagaagcaggacgtggtcgtgctcgggtcccaggagggcgccatgcacaccgccctgaccggggccacggagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgagaccacgatgcgcggcgccaagcggatggccatcctgggggacaccgcctgggacttcggcagcctcggcggggtgttcacctccatcgggaaggccctccaccaggtcttcggggcgatctacggcgccgccttcagcggggtgtcctggaccatgaagatcctgatcggcgtgatcatcacgtggatcgggatgaacagccgctccaccagcctgtccgtcagcctggtgctcgtgggcgtcgtgaccctgtacctgggggtgatggtccaggccgacaccggctgcgtggtgtcctggaagaacaaggagctcaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctggagaacctcatgtggaagcagatcacgcccgagctgaaccacatcctgagcgagaacgaggtgaagctcaccatcatgaccggcgacatcaaggggatcatgcaggccggcaagcggtccctgcgcccgcagcccaccgagctgaagtacagctggaagacgtggggcaaggccaagatgctctccaccgagagccacaaccagaccttcctgatcgacgggcccgagaccgcggagtgcccgaacacgaaccgggcctggaactccctggaggtcgaggactacggcttcggggtgttcagcaccaacatctggctcaagctgcgcgagaagcaggacgtgttctgcgactccaagctgatgagcgccgccatcaaggacaaccgggccgtccacgcggacatgggctactggatcgagtccgccctcaacgacacctggaagatggagaaggccagcttcatcgagatcaagtcctgccactggcccaagagccacaccctgtggtccaacggcgtgctggagagcgagatgatcatccccaagaacttcgccgggcccgtgtcccagcacaactaccgcccgggctaccacacccagacggccgggccctggcacctcggcaagctggagatggacttcgacctgtgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcatcggcaccaagcacgccatcctcctggtcgcggtgagcttcgtgacgctgatcaccgggaacatgtccttccgggacctcggccgcgtcatggtgatggtgggggccaccatgaccgacgacatcggcatgggcgtcacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtgctcaagatcgtccgcaacatggagaagtaccagctggccgtgaccatcatggccatctcctgcgtgccgaacgccgtcatcctgcagaacgcctggaaggtgagctgcacgatcctcgcggccgtgtccgtcagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtgatggccgtcggcatggtgagcatcctggcctccagcctgctcaagaacgacatccccatgaccgggcccctggtggccggcgggctgctcacggtctgctacgtgctgaccggccggagcgcggacctggagctcgagcgcgccgccgacgtgaagtgggaggaccaggccgagatctccgggagctcccccatcctgagcatcaccatctccgaggacggcagcatgtccatcaagaacgaggaggaggagcacaccctgacgatcctcatccggaccggcctgctggtcatcagcggggtgttcccggtgtccatccccatcaccgccgcggcctggtacctctgggaggtcaagaagcagcgcgccggcgtgctgtgggacgtgcccagcccgccgcccgtcgggaaggccgagctggaggacggcgcctaccggatcaagcagcgcgggatcttcggctactcccagatcggcgcgggggtgtacaaggagggcaccttccacaccatgtggcacgtgacgcgcggggccgtcctcatgcaccgcggcaagcggatcgagcccagctgggccgacgtgaagaaggacctgatctcctacgggggcggctggaagctggagggggagtggaaggagggcgaggaggtgcaggtcctcgccctggagcccgggaagaacccccgcgccgtgcagaccaagcccggcctgttcaagaccaacaccgggacgatcggcgcggtgagcctcgacttctcccccggcaccagcgggtcccccatcgtcgaccggaagggcaaggtggtggggctgtacggcaacggcgtcgtgacccgcagcggggcctacgtgtccgccatcgcccagaccgagaagtccatcgaggacaaccccgagatcgaggacgacatcttccggaagaagcgcctgacgatcatggacctccaccccggcgcggggaagaccaagcggtacctgcccgccatcgtccgcgaggccatcaagcggggcctgcgcaccctgatcctcgccccgacccgcgtggtggccgcggagatggaggaggccctgcgggggctgcccatccgctaccagacgcccgccatccgggccgagcacaccggccgcgagatcgtcgacctcatgtgccacgccaccttcaccatgcggctgctgagccccgtgcgcgtgccgaactacaacctcatcatcatggacgaggcgcacttcacggaccccgcctccatcgccgcccggggctacatcagcacccgcgtcgagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgacggacttcaaggggaagaccgtgtggttcgtcccgtccatcaaggccggcaacgacatcgcggcctgcctgcgcaagaacggcaagaaggtgatccagctgagccggaagaccttcgactccgagtacgtgaagacccgcgccaacgactgggacttcgtcgtgacgaccgacatcagcgagatgggggccaacttccgggccgagcgcgtgatcgacccccggcgctgcatgaagcccgtcatcctcaccgacggcgaggagcgggtgatcctggcggggcccatgccggtgacccactccagcgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgggagaaggtcgacgcgatcgacggggagtaccgcctgcggggcgaggcccgcaagaccttcgtggacctcatgcggcgcggggacctgcccgtgtggctggcctaccgggtcgccgccgagggcatcaactacgcggaccgccggtggtgcttcgacgggatcaagaacaaccagatcctcgaggagaacgtggaggtggagatctggaccaaggagggcgagcgcaagaagctgaagccgcggtggctggacgcccgcatctacagcgaccccctcgccctgaaggagttcaaggagttcgccgcgggccggaagtccctgaccctcaacctgatcacggagatggggcgcctgcccaccttcatgacccagaaggcccgggacgccctcgacaacctggccgtcctgcacaccgccgaggtgggcgggcgcgcgtacaaccacgccctcagcgagctgcccgagacgctggagaccctcctgctgctcaccctgctggccaccgtcacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcggacgccccaggacaaccagctcacctacgtggtcatcgccatcctgacggtggtggccgccaccatggcgaacgagatggggttcctggagaagaccaagaaggacctcggcctgggcagcatcaccacgcaggagagcgagtccaacatcctggacatcgacctccgcccggccagcgcctggaccctgtacgccgtcgccaccaccttcgtgacgcccatgctgcggcactccatcgagaacagctccgtgaacgtcagcctcaccgcgatcgccaaccaggccaccgtgctgatggggctgggccgcgggtggcccctctccaagatggacatcggcgtgcccctgctggccatcgggtgctacagccaggtcaacccgatcaccctcacggcggccctgctgctcctggtggcccactacgccatcatcggccccggcctgcaggccaaggcgacccgcgaggcccagaagcggaccgccgccgggatcatgaagaaccccaccgtggacggcatcacggtcatcgacctcgagcccatcccgtacgaccccaagttcgagaagcagctgggccaggtgatgctgctcgtgctgtgcgtcacccaggtgctgatgatgcgcaccacctgggccctctgcgaggcgctgacgctggccaccggccccatctccaccctctgggaggggaaccccggccggttctggaacaccacgatcgccgtgagcatggccaacatcttccgcggctcctacctggccggggcgggcctcctgttcagcatcatgaagaacaccaccaacacccggcgcgggacgggcaacatcggcgagaccctgggggagaagtggaagtcccggctgaacgccctcggcaagagcgagttccagatctacaagaagtccgggatccaggaggtcgaccgcaccctggccaaggagggcatcaagcgcggggagaccgaccaccacgccgtgagccgcggctccgcgaagctgcggtggttcgtggagcgcaacatggtcacgccggagggcaaggtggtggacctcgggtgcggccgcggcgggtggagctactactgcggcgggctgaagaacgtccgcgaggtgaaggggctgaccaagggcggccccgggcacgaggagcccatccccatgtccacctacggctggaacctcgtgcggctgcagagcggggtcgacgtgttcttcaccccgcccgagaagtgcgacacgctgctctgcgacatcggcgagagctcccccaaccccaccgtggaggccggccgcaccctgcgggtcctgaacctcgtggagaactggctgaacaacaacacccagttctgcgtgaaggtcctgaacccgtacatgcccagcgtgatcgagaagatggaggccctccagcgcaagtacgggggcgccctggtgcggaaccccctgtcccgcaacagcacccacgagatgtactgggtctccaacgccacggggaacatcgtgagctccgtgaacatgatcagccgcatgctgatcaaccggttcaccatgaagcacaagaaggcgacctacgagccggacgtcgacctcggctccgggacccgcaacatcggcatcgagagcgagatccccaacctggacatcatcggcaagcggatcgagaagatcaagcaggagcacgagacgtcctggcactacgaccaggaccacccctacaagacctgggcctaccacgggagctacgagaccaagcagaccggctccgccagctccatggtgaacggggtggtcaagctgctcacgaagccctgggacgtggtgccgatggtcacccagatggccatgaccgacaccacgcccttcggccagcagcgcgtgttcaaggagaaggtggacacccggacccaggagcccaaggagggcaccaagaagctgatgcgcatcacggccgagtggctgtggaaggagctcgggcggaagaagacgccccggatgtgcacccgggaggagttcacccgcaaggtccggagcaacgcggccctgggcgccatcttcacggacgagaacaagtggaagtccgcccgcgaggccgtggaggacagccggttctgggagctggtcgaccgcgagcggaacctccacctggaggggaagtgcgagacctgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccgggggaacagcctgtccggcgtggagggggagggcctgcacaagctcggctacatcctgcgcgacgtcagcaagaaggagggcggcgcgatgtacgccgacgacaccgccgggtgggacacccggatcacgctggaggacctcaagaacgaggagatggtgaccaaccacatgaagggcgagcacaagaagctggccgaggccatcttcaagctgacctaccagaacaaggtggtccgcgtgcagcgcccgacgccccgggggacggtgatggacatcatctcccgcaaggaccagcggggcagcggccaggtcgggacctacggcctcaacaccttcaccaacatggaggcgcagctgatccgccagatggagggggagggcatcttcaagtccatccagcggctgacggtgaccgaggagatcgccgtgcagaactggctcgcccgcgtcggccgggagcgcctgagccggatggccatctccggggacgactgcgtggtgaagcccctggacgaccgcttcgccagcgcgctcaccgccctgaacgacatgggcaaggtccggaaggacatccagcagtgggagccctcccgcgggtggaacgactggacccaggtgccgttctgcagccaccacttccacgagctggtgatgaaggacggccgggtcctcgtggtgccctgccgcaaccaggacgagctgatcgggcgggcccgcatctcccagggcgccggctggagcctgaaggagacggcctgcctcgggaagtcctacgcgcagatgtggaccctgatgtacttccaccggcgcgacctgcggctcgccgccaacgccatctgcagcgccgtcccctcccactgggtgcccaccagccgcaccacctggtccatccacgcgaagcacgagtggatgacgaccgaggacatgctggccgtgtggaaccgcgtctggatccaggagaacccgtggatggaggacaagacccccgtggagagctgggaggaggtgccctacctgggcaagcgggaggaccagtggtgcgggagcctcatcggcctgacctcccgcgccacgtgggccaagaacatccagaccgcgatcaaccaggtccggagcctgatcgggaacgaggagtacaccgactacatgccctccatgaagcgcttccggaaggaggaggaggaggccggcgtgctctggtga

SEQ ID NO: 9443 - RNA, 9876 nt, synthetic construct
  misc_feature 1..9876: note = derived and/or modified CDS sequence (opt1) from DENV-2__EU482720__SS-prME
  source 1..9876: mol_type = other RNA
accgccggggtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacgtggatcctgcgccacccgggcttcaccaccatggccgcgatcctggcctacaccatcgggacgacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcacgaccatggccaagaacaagcccaccctggacttcgagctgatcaagaccgaggccaagcagcccgccacgctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacacgatcgtgatcacgccccacagcggggaggagcacgccgtcggcaacgacaccgggaagcacggcaaggagatcaagatcaccccgcagtccagcatcaccgaggccgagctcacggggtacggcaccgtgaccatggagtgcagcccccggaccggcctggacttcaacgagatggtgctgctccagatggaggacaaggcctggctggtccaccggcagtggttcctggacctccccctgccctggctgccgggggccgacacgcagggcagcaactggatccagaaggagaccctcgtgaccttcaagaacccccacgcgaagaagcaggacgtggtcgtgctggggtcccaggagggcgccatgcacaccgccctgacgggggccaccgagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcatggacctcgagaagcggcacgtcctggggcgcctgatcaccgtgaacccgatcgcgaccgagaaggacagccccgtgaacatcgaggccgagccgcccttcggcgactcctacatcatcatcggggtcgagccgggccagctcaagctgaactggttcaagaaggggagctccatcggccagatgttcgagacgaccatgcgcggcgccaagcggatggccatcctgggggacaccgcctgggacttcggcagcctcgggggcgtgttcacctccatcgggaaggcgctgcaccaggtgttcggcgccatctacggcgccgccttcagcggggtctcctggacgatgaagatcctgatcggcgtgatcatcacctggatcgggatgaacagccgctccaccagcctgtccgtgagcctcgtcctggtgggcatcgtgaccctgtacctcggggtcatggtgcaggcggacacgggctgcgtggtctcctggaagaacaaggagctgaagtgcggcagcgggatcttcatcaccgacaacgtgcacacctggaccgagcagtacaagttccagcccgagtcccccagcaagctggccagcgccatccagaaggcccacgaggagggcatctgcgggatccggtccgtgacgcgcctcgagaacctgatgtggaagcagatcacccccgagctgaaccacatcctcagcgagaacgaggtcaagctgaccatcatgaccggcgacatcaaggggatcatgcaggccggcaagcggtccctgcgcccgcagcccacggagctcaagtacagctggaagacctggggcaaggcgaagatgctgtccaccgagagccacaaccagaccttcctgatcgacgggcccgagacggccgagtgcccgaacaccaaccgggcctggaactccctcgaggtggaggactacggcttcggggtgttcagcaccaacatctggctgaagctgcgcgagaagcaggacgtcttctgcgactccaagctcatgagcgccgccatcaaggacaaccgggcggtgcacgccgacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtctcccagcacaactaccgcccgggctaccacacgcagaccgcggggccctggcacctgggcaagctggagatggacttcgacttctgcgaggggaccaccgtggtggtcacggaggactgcggcaaccggggccccagcctccgcaccaccaccgccagcgggaagctgatcacggagtggtgctgccggtcctgcaccctgcccccgctccgctaccggggcgaggacgggtgctggtacggcatggagatccgccccctgaaggagaaggaggagaacctggtgaacagcctcgtgaccgccgggcacggccagatcgacaacttctccctgggcgtcctggggatggccctcttcctggaggagatgctgcggacccgcgtgggcacgaagcacgcgatcctcctggtggccgtcagcttcgtgaccctgatcaccgggaacatgtccttccgggacctcggccgcgtgatggtcatggtgggggccaccatgacggacgacatcggcatgggcgtgacctacctggccctgctcgccgcgttcaaggtccgccccaccttcgccgccgggctgctgctccggaagctgaccagcaaggagctgatgatggccacgatcggcatcgccctcctgtcccagagcaccatccccgagaccatcctggagctcaccgacgcgctggccctggggatgatggtgctcaagatcgtgcgcaacatggagaagtaccagctggccgtcacgatcatggccatctcctgcgtgccgaacgccgtgatcctgcagaacgcgtggaaggtcagctgcaccatcctcgccgccgtgtccgtgagccccctgctgctcacctccagccagcagaaggccgactggatccccctggcgctgaccatcaagggcctcaaccccacggccatcttcctgaccaccctgtcccggaccagcaagaagcgctcctggccgctcaacgaggccgtcatggccgtgggcatggtcagcatcctggcctccagcctgctcaagaacgacatccccatgacggggcccctggtggcgggcgggctgctcaccgtgtgctacgtcctgaccggccggagcgccgacctggagctcgagaaggccgccgacgtgaagtgggaggaccaggccgagatctccgggagctcccccatcctgagcatcaccatctccgaggacggcagcatgtccatcaagaacgaggaggaggagcacacgctgaccatcctcatccgcaccggcctgctggtgatcagcggggtcttcccggtgtccatccccatcaccgcggccgcctggtacctctgggaggtgaagaagcagcgggccggcgtcctgtgggacgtgcccagcccgccgcccgtggggaaggccgagctggaggacggcgcgtaccgcatcaagcagcgggggatcttcggctactcccagatcggcgccggggtctacaaggagggcaccttccacacgatgtggcacgtgacccgcggggccgtgctcatgcaccggggcaagcgcatcgagcccagctgggccgacgtcaagaaggacctgatctcctacgggggcggctggaagctggagggggagtggaaggagggcgaggaggtccaggtgctcgccctggagcccgggaagaacccccgggcggtccagaccaagcccggcctgttcaagaccaacacggggaccatcggcgccgtgagcctcgacttctcccccggcaccagcgggtcccccatcgtggaccgcaagggcaaggtcgtggggctgtacggcaacggcgtggtcacccggagcggggcctacgtgtccgccatcgcgcagacggagaagtccatcgaggacaaccccgagatcgaggacgacatcttccgcaagaagcggctgaccatcatggacctccaccccggcgccgggaagaccaagcgctacctgcccgccatcgtgcgggaggccatcaagcgcggcctgcggaccctgatcctcgccccgacgcgcgtcgtggcggccgagatggaggaggccctgcgcgggctgcccatccggtaccagacccccgccatccgcgccgagcacaccggccgggagatcgtggacctcatgtgccacgcgaccttcacgatgcgcctgctgagccccgtccgggtgccgaactacaacctcatcatcatggacgaggcccacttcaccgaccccgcctccatcgccgcccgcggctacatcagcacccgggtggagatgggggaggcggccggcatcttcatgaccgccacgccgcccgggtcccgcgacccgttcccccagagcaacgcccccatcatggacgaggagcgggagatccccgagcgctcctggaacagcggccacgagtgggtcaccgacttcaaggggaagaccgtgtggttcgtgccgtccatcaaggcgggcaacgacatcgccgcctgcctgcggaagaacggcaagaaggtcatccagctgagccgcaagaccttcgactccgagtacgtgaagacgcgggccaacgactgggacttcgtggtcaccaccgacatcagcgagatgggggccaacttccgcgcggagcgggtgatcgacccccgccggtgcatgaagcccgtgatcctcaccgacggcgaggagcgcgtcatcctggccgggcccatgccggtgacgcactccagcgccgcccagcggcgcggccgcatcgggcggaaccccaagaacgagaacgaccagtacatctacatgggcgagcccctggagaacgacgaggactgcgcccactggaaggaggcgaagatgctcctggacaacatcaacacccccgagggcatcatcccgtccatgttcgagcccgagcgcgagaaggtggacgccatcgacggggagtaccggctgcgcggcgaggcccggaagaccttcgtcgacctcatgcgccgcggggacctgcccgtgtggctggcctaccgcgtggccgcggagggcatcaactacgccgaccggcgctggtgcttcgacgggatcaagaacaaccagatcctcgaggagaacgtcgaggtggagatctggaccaaggagggcgagcggaagaagctgaagccgcgctggctggacgcccggacgtacagcgaccccctcgccctgaaggagttcaaggagttcgcggccggccgcaagtccctgaccctcaacctgatcaccgagatggggcggctgcccaccttcatgacgcagaaggcccgcgacgccctcgacaacctggccgtgctgcacaccgcggaggtcggcgggcgggcctacaaccacgccctcagcgagctgcccgagaccctggagaccctcctgctgctcacgctgctggccaccgtgaccggcggcatcttcctcttcctgatgtccgggaagggcatcgggaagatgaccctgggcatgtgctgcatcatcaccgccagcatcctcctgtggtacgcgcagatccagccgcactggatcgccgcctccatcatcctggagttcttcctcatcgtcctgctgatccccgagcccgagaagcagcgcacgccccaggacaaccagctcacctacgtggtgatcgccatcctgaccgtcgtggccgcgaccatggccaacgagatggggttcctggagaagacgaagaaggacctcggcctgggcagcatcaccacccaggagagcgagtccaacatcctggacatcgacctccggccggccagcgcctggaccctgtacgccgtggcgacgaccttcgtcacccccatgctgcgccactccatcgagaacagctccgtgaacgtgagcctcaccgccatcgccaaccaggccacggtcctgatggggctgggccgggggtggcccctctccaagatggacatcggcgtgcccctgctggcgatcgggtgctacagccaggtgaacccgatcaccctcaccgccgccctgctgctcctggtcgcccactacgccatcatcggccccggcctgcaggcgaaggccacccgcgaggcccagaagcgcacggccgccgggatcatgaagaaccccaccgtggacggcatcaccgtgatcgacctcgagcccatcccgtacgaccccaagttcgagaagcagctggggcaggtcatgctgctcgtgctgtgcgtgacccaggtcctgatgatgcggacgacctgggcgctctgcgaggccctgaccctggccaccggccccatctccacgctctgggaggggaaccccggccgcttctggaacaccaccatcgccgtgagcatggccaacatcttccggggctcctacctggcgggggccggcctcctcttcagcatcatgaagaacaccacgaacacccgccgggggaccggcaacatcggcgagaccctgggggagaagtggaagtcccgcctgaacgccctcggcaagagcgagttccagatctacaagaagtccgggatccaggaggtggaccggacgctggccaaggagggcatcaagcgcggggagaccgaccaccacgcggtcagccggggctccgccaagctgcgctggttcgtggagcggaacatggtgaccccggagggcaaggtcgtggacctcgggtgcggccgcgggggctggagctactactgcgggggcctgaagaacgtgcgggaggtcaagggcctgaccaagggcgggcccgggcacgaggagcccatccccatgtccacgtacggctggaacctcgtgcgcctgcagagcggggtggacgtcttcttcaccccgcccgagaagtgcgacaccctgctctgcgacatcggcgagagctcccccaaccccaccatcgaggccggccggaccctgcgcgtgctgaacctcgtggagaactggctgaacaacaacacgcagttctgcgtcaaggtgctgaacccgtacatgcccagcgtgatcgagaagatggagaccctccagcggaagtacgggggcgccctggtccgcaaccccctgtcccggaacagcacccacgagatgtactgggtgtccaacgccaccgggaacatcgtgagctccgtcaacatgatcagccgcatgctgatcaaccgcttcacgatgaagcacaagaaggcgacctacgagccggacgtggacctcggctccgggacccggaacatcggcatcgagaacgagatccccaacctggacatcatcggcaagcgcatcgagaagatcaagcaggagcacgagaccagctggcactacgaccaggaccacccctacaagacgtgggcctaccacgggtcctacgagaccaagcagaccggcagcgcctccagcatggtgaacggggtcgtgaagctgctcaccaagccctgggacgtggtcccgatggtgacgcagatggccatgaccgacaccacccccttcggccagcagcgggtgttcaaggagaaggtcgacacgcgcacccaggagcccaaggagggcaccaagaagctgatgcggatcaccgccgagtggctgtggaaggagctcgggaagaagaagacgccccgcatgtgcacccgggaggagttcacccgcaaggtgcggtccaacgcggccctgggcgccatcttcaccgacgagaacaagtggaagtccgcccgcgaggccgtggaggactcccggttctgggagctggtcgaccgcgagcggaacctccacctggaggggaagtgcgagacgtgcgtgtacaacatgatgggcaagcgcgagaagaagctgggggagttcggcaaggcgaagggcagccgggccatctggtacatgtggctcggggcccgcttcctggagttcgaggccctgggcttcctcaacgaggaccactggttctcccgggggaacagcctgagcggcgtcgagggggagggcctgcacaagctcggctacatcctgcgcgacgtgtccaagaaggagggcggggcgatgtacgccgacgacaccgccgggtgggacacccggatcaccctggaggacctcaagaacgaggagatggtgacgaaccacatgaagggcgagcacaagaagctggccgaggccatcttcaagctgacctaccagaacaaggtcgtgcgcgtgcagcggccgacgccccgcgggaccgtcatggacatcatcagccgcaaggaccagcggggctccggccaggtggggacgtacggcctcaacaccttcaccaacatggaggcgcagctgatccgccagatggagggggagggcatcttcaagagcatccagcggctgaccgtgacggaggagatcgccgtccagaactggctcgcccgcgtgggccgggagcgcctgtcccggatggccatcagcggggacgactgcgtggtcaagcccctggacgaccgcttcgcctccgcgctcaccgccctgaacgacatgggcaaggtgcggaaggacatccagcagtgggagcccagccgcgggtggaacgactggacccaggtgccgttctgctcccaccacttccacgagctggtcatgaaggacggccggatgctcgtggtgccctgccgcaaccaggacgagctgatcgggcgggcccgcatcagccagggcgccggctggtccctgaaggagaccgcctgcctcggcaagagctacgcgcagatgtggaccctgatgtacttccaccggcgcgacctgcggctcgccgccaacgccatctgctccgccgtccccagccactgggtgcccacgtcccgcaccacctggagcatccacgcgaagcacgagtggatgaccacggaggacatgctggccgtgtggaaccgggtctggatccaggagaacccgtggatggaggacaagacccccgtggagtcctgggaggaggtgccctacctgggcaagcgcgaggaccagtggtgcgggagcctcatcggcctgaccagccgcgccacctgggccaagaacatccagacggcgatcaaccaggtccggtccctgatcgggaacgaggagtacaccgactacatgcccagcatgaagcgcttccggaaggaggaggaggaggccggcgtgctctggtga

SEQ ID NO: 9444 - RNA, 9876 nt, synthetic construct
  misc_feature 1..9876: note = derived and/or modified CDS sequence (opt1) from DENV-2__EU482721__SS-prME
  source 1..9876: mol_type = other RNA
accgccggcgtgatcatcatgctgatccccaccgccatggcgttccacctcaccacccgcaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagggggcctggaagcacgtccagcggatcgagacctggatcctgcgccacccgggcttcaccaccatggccgcgatcctggcctacaccatcgggaccacccacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcacgaccatggccaagaacaagcccaccctggacttcgagctgatcaagaccgaggccaagcagcccgccacgctccgcaagtactgcatcgaggccaagctgaccaacaccaccacggagtcccggtgcccgacccagggcgagcccagcctgaacgaggagcaggacaagcgcttcatctgcaagcactccatggtggaccggggctgggggaacggctgcgggctgttcggcaagggcgggatcgtgacctgcgcgatgttcacgtgcaagaagaacatggagggcaaggtcgtgcagcccgagaacctggagtacacgatcgtgatcacgccccacagcggggaggagcacgccgtcggcaacgacaccgggaagcacggcaaggagatcaagatcaccccgcagtccagcatcaccgaggccgagctgacggggtacggcaccgtgaccatggagtgcagcccccggaccggcctcgacttcaacgagatggtgctgctgcagatggaggacaaggcctggctcgtccaccggcagtggttcctggacctgcccctcccctggctgccgggggccgacacgcagggcagcaactggatccagaaggagaccctggtgaccttcaagaacccccacgcgaagaagcaggacgtggtcgtgctcgggtcccaggagggcgccatgcacaccgccctgacgggggccaccgagatccagatgagcagcggcaacctcctgttcaccggccacctgaagtgccgcctgcggatggacaagctccagctgaaggggatgtcctacagcatgtgcaccggcaagttcaagatcgtcaaggagatcgccgagacgcagcacgggaccatcgtgatccgcgtgcagtacgagggcgacggctccccctgcaagatccccttcgagatcatggacctggagaagcggcacgtcctcgggcgcctgatcaccgtgaacccgatcgtgaccgagaaggacagccccgtcaacatcgaggcggagccgcccttcggcgactcctacatcatcatcggggtggagccgggccagctgaagctcaactggttcaagaaggggagctccatcggccagatgttcgagacgaccatgcgcggcgccaagcggatggccatcctgggggacaccgcctgggacttcggcagcctcggcggggtgttcacctccatcgggaaggccctccaccaggtcttcggggcgatctacggcgccgccttcagcggggtgtcctggacgatgaagatcctgatcggcgtgatcatcacctggatcgggatgaacagccgctccaccagcctgtccgtcagcctggtgctcgtgggcatcgtcaccctgtacctgggggtgatggtgcaggccgacacgggctgcgtcgtgtcctggaagaacaaggagctcaagtgcggcagcgggatcttcatcaccgacaacgtgcacacctggaccgagcagtacaagttccagcccgagtcccccagcaagctggcgagcgccatccagaaggcccacgaggagggcatctgcgggatccggtccgtcacgcgcctggagaacctcatgtggaagcagatcacccccgagctgaaccacatcctgagcgagaacgaggtgaagctcaccatcatgaccggcgacatcaaggggatcatgcaggccggcaagcggtccctgcgcccgcagcccacggagctgaagtacagctggaagacctggggcaaggccaagatgctctccaccgagagccacaaccagaccttcctgatcgacgggcccgagacggcggagtgcccgaacaccaaccgggcctggaactccctggaggtggaggactacggcttcggggtcttcagcaccaacatctggctcaagctgcgcgagaagcaggacgtgttctgcgactccaagctgatgagcgccgccatcaaggacaaccgggccgtgcacgcggacatgggctactggatcgagtccgccctcaacgacacctggaagatggagaaggccagcttcatcgagatcaagtcctgccactggcccaagagccacaccctgtggtccaacggcgtcctggagagcgagatgatcatccccaagaacttcgccgggcccgtgtcccagcacaactaccgcccgggctaccacacgcagaccgccgggccctggcacctcggcaagctggagatggacttcgacttctgcgaggggaccaccgtggtcgtgacggaggactgcggcaaccggggccccagcctgcgcaccaccaccgcgagcgggaagctcatcacggagtggtgctgccggtcctgcaccctgcccccgctgcgctaccggggcgaggacgggtgctggtacggcatggagatccgccccctcaaggagaaggaggagaacctggtgaacagcctggtcaccgccgggcacggccagatcgacaacttctccctcggcgtgctggggatggccctgttcctcgaggagatgctgcggacccgcatcggcacgaagcacgccatcctgctcgtggcggtcagcttcgtgaccctgatcaccgggaacatgtccttccgggacctgggccgcgtgatggtcatggtgggggccaccatgacggacgacatcggcatgggcgtgacctacctcgccctgctggccgccttcaaggtccgccccaccttcgcggccgggctcctgctgcggaagctcaccagcaaggagctgatgatggccacgatcggcatcgccctgctctcccagagcaccatccccgagaccatcctggagctgaccgacgccctcgcgctggggatgatggtgctgaagatcgtgcgcaacatggagaagtaccagctcgccgtcacgatcatggccatctcctgcgtgccgaacgccgtgatcctgcagaacgcctggaaggtcagctgcaccatcctggcggccgtgtccgtgagccccctcctgctgacctccagccagcagaaggccgactggatccccctcgccctgaccatcaagggcctgaaccccacggcgatcttcctcaccaccctgtcccggaccagcaagaagcgctcctggccgctgaacgaggccatcatggccgtcggcatggtgagcatcctcgcctccagcctgctgaagaacgacatccccatgacggggcccctcgtcgccggcgggctgctgaccgtgtgctacgtgctcaccggccggagcgcggacctggagctggagcgcgccgccgacgtcaagtgggaggaccaggccgagatctccgggagctcccccatcctcagcatcaccatctccgaggacggcagcatgtccatcaagaacgaggaggaggagcacacgctgaccatcctgatccggaccggcctcctggtgatcagcggggtgttcccggtctccatccccatcaccgccgcggcctggtacctgtgggaggtgaagaagcagcgcgccggcgtgctctgggacgtccccagcccgccgcccgtggggaaggccgagctggaggacggcgcctaccggatcaagcagcgcgggatcttcggctactcccagatcggcgcgggggtgtacaaggagggcaccttccacacgatgtggcacgtcacccgcggggccgtgctgatgcaccgcggcaagcggatcgagcccagctgggccgacgtgaagaaggacctcatctcctacgggggcggctggaagctggagggggagtggaaggagggcgaggaggtccaggtgctggccctcgagcccgggaagaacccccgcgccgtgcagaccaagcccggcctgttcaagaccaacacggggaccatcggcgcggtcagcctggacttctcccccggcaccagcgggtcccccatcgtggaccggaagggcaaggtggtcgggctctacggcaacggcgtggtgacccgcagcggggcctacgtctccgccatcgcccagacggagaagtccatcgaggacaaccccgagatcgaggacgacatcttccggaagaagcgcctgaccatcatggacctgcaccccggcgcggggaagaccaagcggtacctccccgccatcgtgcgcgaggccatcaagcggggcctgcgcaccctgatcctggccccgacgcgcgtggtcgccgcggagatggaggaggccctccgggggctgcccatccgctaccagacccccgccatccgggccgagcacaccggccgcgagatcgtggacctgatgtgccacgccaccttcacgatgcggctcctgagccccgtgcgcgtcccgaactacaacctgatcatcatggacgaggcgcacttcaccgaccccgcctccatcgccgcccggggctacatcagcacccgcgtggagatgggggaggccgcgggcatcttcatgaccgccacgccgcccgggtcccgggacccgttcccccagagcaacgcccccatcatggacgaggagcgcgagatccccgagcggtcctggaacagcggccacgagtgggtgaccgacttcaaggggaagaccgtctggttcgtgccgtccatcaaggccggcaacgacatcgcggcctgcctccgcaagaacggcaagaaggtgatccagctgagccggaagaccttcgactccgagtacgtcaagacgcgcgccaacgactgggacttcgtggtgaccaccgacatcagcgagatgggggccaacttccgggccgagcgcgtcatcgacccccggcgctgcatgaagcccgtgatcctgaccgacggcgaggagcgggtgatcctcgcggggcccatgccggtcacgcactccagcgccgcccagcgccgcggccggatcgggcgcaaccccaagaacgagaacgaccagtacatctacatgggcgagcccctggagaacgacgaggactgcgcccactggaaggaggccaagatgctgctcgacaacatcaacacccccgagggcatcatcccgtccatgttcgagcccgagcgggagaaggtggacgcgatcgacggggagtaccgcctgcggggcgaggcccgcaagaccttcgtggacctgatgcggcgcggggacctccccgtctggctggcctaccgggtggccgccgagggcatcaactacgcggaccgccggtggtgcttcgacgggatcaagaacaaccagatcctggaggagaacgtggaggtcgagatctggaccaaggagggcgagcgcaagaagctcaagccgcggtggctggacgcccgcatctacagcgaccccctggccctcaaggagttcaaggagttcgccgcgggccggaagtccctgacgctgaacctcatcaccgagatggggcgcctgcccaccttcatgacccagaaggcccgggacgccctggacaacctcgccgtgctgcacacggccgaggcgggcgggcgcgcctacaaccacgccctgagcgagctccccgagaccctggagaccctgctcctgctgaccctcctggccacggtgaccggcggcatcttcctgttcctcatgtccgggaagggcatcgggaagatgaccctgggcatgtgctgcatcatcaccgccagcatcctgctctggtacgcgcagatccagccgcactggatcgccgcctccatcatcctggagttcttcctgatcgtcctcctgatccccgagcccgagaagcagcggacgccccaggacaaccagctgacgtacgtggtcatcgccatcctcaccgtggtggccgcgaccatggccaacgagatggggttcctggagaagaccaagaaggacctgggcctcggcagcatcacgacccaggagagcgagtccaacatcctggacatcgacctgcgcccggccagcgcctggaccctctacgccgtcgcgaccacgttcgtgacccccatgctgcggcactccatcgagaacagctccgtgaacgtcagcctgaccgccatcgccaaccaggccaccgtgctcatggggctgggcaaggggtggcccctgtccaagatggacatcggcgtgcccctcctggcgatcgggtgctacagccaggtcaacccgatcacgctgaccgccgccctcctgctgctcgtggcccactacgccatcatcggccccggcctgcaggcgaaggccacccgcgaggcccagaagcgcgccgccgcggggatcatgaagaaccccaccgtggacggcatcacggtcatcgacctggagcccatcccgtacgaccccaagttcgagaagcagctcggccaggtgatgctgctgatcctctgcgtgacccaggtcctgatgatgcggaccacctgggccctgtgcgaggccctcacgctggccaccggccccatctccaccctgtgggaggggaaccccggccgcttctggaacaccacgatcgccgtgagcatggcgaacatcttccggggctcctacctcgccggggccggcctgctgttcagcatcatgaagaacaccaccaacacccgccgggggacgggcaacatcggcgagaccctcggggagaagtggaagtcccgcctgaacgccctgggcaagagcgagttccagatctacaagaagtccgggatccaggaggtggaccggaccctcgcgaaggagggcatcaagcgcggggagaccgaccaccacgccgtcagccggggctccgccaagctgcgctggttcgtggagcggaacatggtgacgccggagggcaaggtcgtggacctggggtgcggccgcgggggctggagctactactgcgggggcctcaagaacgtgcgggaggtcaagggcctgaccaagggcggccccgggcacgaggagcccatccccatgtccacctacggctggaacctggtgcgcctccagagcggggtggacgtcttcttcaccccgcccgagaagtgcgacacgctgctgtgcgacatcggcgagagctcccccaaccccaccatcgaggccggccggaccctccgcgtgctgaacctggtggagaactggctcaacaacaacacccagttctgcatcaaggtcctgaacccgtacatgcccagcgtgatcgagaagatggaggccctgcagcggaagtacgggggcgcgctcgtgcgcaaccccctgtcccggaacagcacccacgagatgtactgggtctccaacgccacggggaacatcgtgagctccgtgaacatgatcagccgcatgctgatcaaccgcttcaccatgaagcacaagaaggccacctacgagccggacgtcgacctgggctccgggacccggaacatcggcatcgagagcgagatccccaacctcgacatcatcggcaagcgcatcgagaagatcaagcaggagcacgagacgtcctggcactacgaccaggaccacccctacaagacctgggcctaccacgggagctacgagaccaagcagaccggctccgccagctccatggtgaacggggtggtccggctgctgacgaagccctgggacgtggtgccgatggtcacccagatggcgatgaccgacaccacgcccttcggccagcagcgcgtgttcaaggagaaggtggacacccggacccaggagcccaaggagggcaccaagaagctcatgaagatcacggccgagtggctgtggaaggagctggggaagaagaagacgccccgcatgtgcacccgggaggagttcacccgcaaggtccggagcaacgccgccctcggcgccatcttcacggacgagaacaagtggaagtccgcgcgcgaggccgtggaggacgggcggttctgggagctggtggaccgcgagcggaacctgcacctcgagggcaagtgcgagacctgcgtctacaacatgatggggaagcgcgagaagaagctgggcgagttcggcaaggccaaggggagccgggccatctggtacatgtggctgggcgcgcgcttcctcgagttcgaggccctggggttcctgaacgaggaccactggttctcccggggcaacagcctcagcggggtggagggcgagggcctgcaccgcctggggtacatcctccgggacgtgtccaagaaggagggcggggccatgtacgccgacgacaccgccggctgggacacccgcatcacgctggaggacctgaagaacgaggagatggtcaccaaccacatgaagggggagcacaagaagctcgcggaggccatcttcaagctgacctaccagaacaaggtggtccgggtgcagcgcccgacgccccgcggcacggtgatggacatcatcagccggaaggaccagcgcggctccgggcaggtcggcacctacgggctgaacaccttcaccaacatggaggcccagctcatccggcagatggagggcgagggcatcttcaagagcatccagcgcctgacggtgaccgaggagatcgccgtgcagaactggctggcccgggtcgggcgcgagcggctctcccgcatggcgatcagcggcgacgactgcgtggtgaagcccctggacgaccggttcgcctccgccctgaccgccctcaacgacatggggaaggtccgcaaggacatccagcagtgggagcccagccggggctggaacgactggacccaggtgccgttctgctcccaccacttccacgagctggtgatgaaggacgggcgcatgctggtcgtgccctgccggaaccaggacgagctcatcggccgcgcccggatcagccagggcgcggggtggtccctgaaggagacggcctgcctgggcaagagctacgcccagatgtggaccctcatgtacttccaccgccgggacctgcgcctggccgccaacgcgatctgctccgccgtgcccagccactgggtccccacctcccggaccacctggagcatccacgccaagcacgagtggatgacgaccgaggacatgctcgccgtgtggaaccgcgtgtggatccaggagaacccgtggatggaggacaagacccccgtcgagtcctgggaggaggtgccctacctggggaagcgcgaggaccagtggtgcggcagcctgatcgggctcaccagccgggcgacgtgggccaagaacatccagaccgccatcaaccaggtgcgctccctgatcggcaacgaggagtacaccgactacatgcccagcatgaagcggttccgcaaggaggaggaggaggccggcgtcctgtggtga

SEQ ID NO: 9445 - RNA, 9876 nt, synthetic construct
  misc_feature 1..9876: note = derived and/or modified CDS sequence (opt1) from DENV-2__EU482722__SS-prME
  source 1..9876: mol_type = other RNA
accgccggcgtgatcatcatgctgatccccaccgccatggcgttccacctcaccacccggaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaactccaccagcacctgggtgacctacgggacctgcaccaccacgggcgagcaccggcgcgagaagcggtccgtcgccctggtgccccacgtggggatgggcctcgagacccggaccgagacctggatgagctccgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtcgtggtgaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtcaactccctcgtgacggccgggcacggccagatcgacaacttcagcctgggcgtgctggggatggccctcttcctggaggagatgctgcggacccgcgtcggcaccaagcacgccatcctcctggtggcggtgtccttcgtcaccctgatcacggggaacatgagcttccgggacctcggccgcgtgatggtgatggtcggggccaccatgaccgacgacatcggcatgggcgtgacctacctggccctgctcgccgccttcaaggtgcgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtcatggccgtgggcatggtgtccatcctggccagcagcctgctcaagaacgacatccccatgaccgggcccctggtcgccggcgggctgctcaccgtgtgctacgtgctgacgggccggtccgcggacctggagctcgagcgcgtcgccgacgtgaagtgggaggaccaggccgagatcagcgggtccagccccatcctgtccatcaccatcagcgaggacggctccatgagcatcaagaacgaggaggaggagcacaccctgaccatcctcatccggacgggcctgctggtgatctccggggtcttcccggtgagcatccccatcaccgccgccgcgtggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgccggggtctacaaggagggcaccttccacaccatgtggcacgtgacccgcggggcggtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgccgtgtccctcgacttcagccccggcacgtccgggagccccatcgtggaccggaagggcaaggtcgtggggctgtacggcaacggcgtggtcacccgctccggggcgtacgtgagcgccatcgcccagaccgagaagtccatcgaggacaaccccgagatcgaggacgacatcttccggaagaagcgcctgaccatcatggacctccaccccggcgccgggaagacgaagcggtacctgcccgcgatcgtgcgcgaggccatcaagcggggcctgcgcaccctgatcctcgccccgacccgcgtcgtggccgccgagatggaggaggcgctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcccacttcaccgaccccgcgagcatcgccgcccggggctacatctccacgcgcgtggagatgggggaggccgccggcatcttcatgaccgcgacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgccgcgtgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggccgggcccatgccggtgacccacagctccgcggcccagcgccgcggccggatcgggcgcaaccccaagaacgagaacgaccagtacatctacatgggcgagcccctggagaacgacgaggactgcgcccactggaaggaggccaagatgctcctggacaacatcaacacccccgagggcatcatcccgagcatgttcgagcccgagcgggagaaggtggacgccatcgacggggagtaccgcctgcggggcgaggcgcgcaagacgttcgtcgacctcatgcggcgcggggacctgcccgtgtggctggcctaccgggtggccgccgagggcatcaactacgccgaccgccggtggtgcttcgacgggatcaagaacaaccagatcctcgaggagaacgtcgaggtggagatctggaccaaggagggcgagcgcaagaagctgaagccgcggtggctggacgcgcgcatctactccgaccccctcgccctgaaggagttcaaggagttcgccgccggccggaagaccctgaccctcaacctgatcacggagatggggcgcctgcccaccttcatgacccagaaggcgcgggacgccctcgacaacctggccgtcctgcacaccgccgaggtgggcgggcgcgcctacaaccacgcgctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgccgcgtccatcatcctggagttcttcctcatcgtcctgctgatccccgagcccgagaagcagcggacgccccaggacaaccagctcacctacgtggtgatcgccatcctgacggtcgtggccgccaccatggccaacgagatggggttcctggagaagaccaagaaggacctcggcctgggcagcatcaccacgcaggagagcgagtccaacatcctggacatcgacctccgcccggcgagcgcctggaccctgtacgccgtggccaccaccttcgtcacgcccatgctgcggcactccatcgagaacagctccgtgaacgtgagcctcaccgccatcgcgaaccaggccaccgtcctgatggggctgggccgcgggtggcccctctccaagatggacatcggcgtgcccctgctggccatcgggtgctacagccaggtgaacccgatcaccctcacggccgcgctgctgctcctggtcgcccactacgccatcatcggccccggcctgcaggccaaggccacccgcgaggcgcagaagcggaccgccgccgggatcatgaagaaccccaccgtggacggcatcacggtgatcgacctcgagcccatcccgtacgaccccaagttcgagaagcagctggggcaggtcatgctgctcgtgctgtgcgtgacccaggtcctgatgatgcgcaccacctgggccctctgcgaggccctgacgctggcgaccggccccatctccaccctctgggaggggaaccccggccggttctggaacaccacgatcgccgtgagcatggccaacatcttccgcggctcctacctggccggggccggcctcctcttcagcatcatgaagaacaccaccaacacccggcgcgggacgggcaacatcggcgagaccctgggggagaagtggaagtcccggctgaacgcgctcggcaagagcgagttccagatctacaagaagtccgggatccaggaggtggaccgcaccctggccaaggagggcatcaagcgcggggagaccgaccaccacgccgtcagccgcggctccgccaagctgcggtggttcgtggagcgcaacatggtgacgccggagggcaaggtcgtggacctcgggtgcggccgcggcgggtggagctactactgcggcgggctgaagaacgtgcgcgaggtcaaggggctgaccaagggcgggcccgggcacgaggagcccatccccatgtccacctacggctggaacctcgtgcggctgcagagcggggtggacgtcttcttcaccccgcccgagaagtgcgacacgctgctctgcgacatcggcgagagctcccccaaccccaccatcgaggcgggccgcaccctgcgggtgctgaacctcgtggagaactggctgaacaacaacacccagttctgcgtcaaggtgctgaacccgtacatgcccagcgtgatcgagaagatggagaccctccagcgcaagtacgggggcgccctggtccggaaccccctgtcccgcaacagcacgcacgagatgtactgggtgtccaacgccaccgggaacatcgtgagctccgtcaacatgatcagccgcatgctgatcaaccggttcaccatgaagcacaagaaggccacctacgagccggacgtggacctcggctccgggacgcgcaacatcggcatcgagaacgagatccccaacctggacatcatcggcaagcggatcgagaagatcaagcaggagcacgagaccagctggcactacgaccaggaccacccctacaagacctgggcctaccacgggtcctacgagaccaagcagacgggcagcgcgtccagcatggtgaacggggtcgtgaagctgctcaccaagccctgggacgtgatcccgatggtcacccagatggccatgaccgacacgacccccttcggccagcagcgcgtgttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtccgctccaacgccgccctgggcgcgatcttcaccgacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggccaagggcagccgcgccatctggtacatgtggctcggggcgcggttcctggagttcgaggccctgggcttcctcaacgaggaccactggttctcccgcgggaacagcctgagcggcgtggagggggagggcctgcacaagctcggctacatcctgcgggacgtctccaagaaggagggcggggccatgtacgccgacgacaccgcggggtgggacacgcgcatcaccctggaggacctcaagaacgaggagatggtgaccaaccacatgaagggcgagcacaagaagctggccgaggccatcttcaagctgacctaccagaacaaggtggtccgggtgcagcgcccgacgccccgcgggaccgtgatggacatcatcagccggaaggaccagcgcggctccggccaggtcgggacctacggcctcaacaccttcacgaacatggaggcccagctgatccggcagatggagggggagggcatcttcaagagcatccagcgcctgaccgtgaccgaggagatcgccgtgcagaactggctcgcgcgggtcggccgcgagcggctgtcccgcatggccatcagcggggacgactgcgtggtgaagcccctggacgaccggttcgcctccgccctcaccgccctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcgcggatcagccagggcgccggctggtccctgaaggagaccgcctgcctcggcaagagctacgcccagatgtggaccctgatgtacttccaccgccgggacctgcgcctcgccgcgaacgccatctgctccgccgtccccagccactgggtgcccacctcccggaccacgtggagcatccacgccaagcacgagtggatgaccaccgaggacatgctggccgtgtggaaccgcgtctggatccaggagaacccgtggatggaggacaagacccccgtggagtcctgggaggaggtgccctacctgggcaagcgcgaggaccagtggtgcgggagcctcatcggcctgacgagccgggcgacctgggccaagaacatccagaccgccatcaaccaggtccgctccctgatcgggaacgaggagtacaccgactacatgcccagcatgaagcggttccgcaaggaggaggaggaggccggcgtgctctggtga

SEQ ID NO: 9446 - RNA, 9876 nt, synthetic construct
  misc_feature 1..9876: note = derived and/or modified CDS sequence (opt1) from DENV-2__EU482723__SS-prME
  source 1..9876: mol_type = other RNA
accgccggcgtgatcatcatgctgatccccaccgccatggcgttccacctcaccacccgcaacggggagccccacatgatcgtcggccggcaggagaagggcaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagctccgagcgggcctggaagcacgtccagcgcatcgagacctggatcctgcggcacccggggttcaccatcatggccgcgatcctggcctacaccatcggcaccacgcacttccagcgcgccctcatcttcatcctgctgaccgccgtggcgcccagcatgaccatgcggtgcatcgggatctccaaccgcgacttcgtggagggcgtcagcggcgggtcctgggtggacatcgtgctcgagcacggcagctgcgtcaccacgatggccaagaacaagcccaccctggacttcgagctgatcaagaccgaggccaagcagcccgccaccctccggaagtactgcatcgaggccaagctgacgaacaccaccaccgagtcccgctgcccgacgcagggggagcccagcctgaacgaggagcaggacaagcggttcatctgcaagcactccatggtggaccgcggctggggcaacgggtgcggcctcttcgggaagggcgggatcgtgacctgcgcgatgttcacgtgcaagaagaacatggagggcaaggtcgtgctgcccgagaacctggagtacaccatcgtgatcacgccccacagcggcgaggagcacgccgtcgggaacgacaccggcaagcacgggaaggagatcaagatcaccccgcagtccagcatcaccgaggccgagctcaccggctacgggacggtgaccatggagtgcagcccccggaccggcctggacttcaacgagatggtgctgctccagatggaggacaaggcctggctggtccaccgccagtggttcctggacctccccctgccctggctgccgggcgccgacacccaggggagcaactggatccagaaggagacgctcgtgaccttcaagaacccccacgcgaagaagcaggacgtggtcgtgctgggctcccaggagggggccatgcacaccgccctgaccggcgccacggagatccagatgagcagcgggaacctcctgttcaccggccacctgaagtgccggctccgcatggacaagctgcagctgaagggcatgtcctacagcatgtgcaccgggaagttcaagatcgtcaaggagatcgccgagacccagcacggcacgatcgtgatccgggtgcagtacgagggggacggctccccctgcaagatccccttcgagatcatggacctcgagaagcgccacgtcctgggccgcctgatcaccgtgaacccgatcgtgaccgagaaggacagccccgtcaacatcgaggcggagccgcccttcggggactcctacatcatcatcggcgtggagccggggcagctcaagctgaactggttcaagaagggcagctccatcgggcagatgttcgagaccacgatgcggggcgccaagcgcatggccatcctgggcgacaccgcctgggacttcgggagcctcggcggggtgttcacctccatcggcaaggccctgcaccaggtcttcggggcgatctacggcgccgccttcagcggcgtgtcctggaccatgaagatcctgatcggggtgatcatcacgtggatcggcatgaacagccggtccaccagcctgtccgtcagcctcgtgctggtgggggtcgtgaccctgtacctcggcgtgatggtccaggccgactccgggtgcgtggtgagctggaagaacaaggagctgaagtgcggctccggcatcttcatcaccgacaacgtccacacgtggaccgagcagtacaagttccagcccgagagccccagcaagctggcgtccgccatccagaaggcccacgaggaggggatctgcggcatccgcagcgtgacccggctcgagaacctgatgtggaagcagatcacccccgagctgaaccacatcctctccgagaacgaggtgaagctgacgatcatgaccggggacatcaagggcatcatgcaggccgggaagcgcagcctgcggccgcagcccaccgagctcaagtactcctggaagacctggggcaaggccaagatgctgagcacggagtcccacaaccagaccttcctgatcgacggccccgagaccgcggagtgcccgaacaccaaccgcgcctggaacagcctcgaggtcgaggactacgggttcggcgtgttctccacgaacatctggctgaagctgcgggagaagcaggacgtgttctgcgacagcaagctcatgtccgccgccatcaaggacaaccgcgccgtccacgcggacatggggtactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccggccccgtgagccagcacaactaccggccggggtaccacacccagaccgccggcccctggcacctggggaagctggagatggacttcgacttctgcgagggcacgaccgtcgtggtgaccgaggactgcgggaaccgcggccccagcctccggaccacgaccgcgtccggcaagctgatcaccgagtggtgctgccgcagctgcaccctgcccccgctccggtaccgcggggaggacggctgctggtacgggatggagatccggcccctgaaggagaaggaggagaacctggtcaactccctcgtgacggccggccacgggcagatcgacaacttcagcctgggcgtgctgggcatggccctcttcctggaggagatgctgcgcacccgggtcgggaccaagcacgccatcctcctggtggcggtgtccttcgtcaccctgatcacgggcaacatgagcttccgcgacctcgggcgcgtgatggtgatggtcggcgccaccatgaccgacgacatcgggatgggcgtgacctacctggccctgctcgccgccttcaaggtgcggcccacgttcgcggccggcctgctgctccgcaagctgacctccaaggagctgatgatggccaccatcgggatcgccctcctgagccagtccaccatccccgagacgatcctggagctcaccgacgccctggcgctgggcatgatggtcctcaagatcgtgcggaacatggagaagtaccagctggccgtgaccatcatggccatcagctgcgtcccgaacgccgtgatcctgcagaacgcctggaaggtgtcctgcaccatcctcgcggccgtcagcgtgagccccctgctgctcacgagctcccagcagaaggccgactggatccccctggccctgaccatcaaggggctcaaccccaccgcgatcttcctgaccacgctgagccgcacctccaagaagcggagctggccgctcaacgaggccgtcatggccgtgggcatggtgtccatcctggccagcagcctgctcaagaacgacatccccatgaccggccccctggtcgccgggggcctgctcaccgtgtgctacgtgctgacggggcgctccgcggacctggagctcgagcgggccgccgacgtcaagtgggaggaccaggccgagatcagcggctccagccccatcctgtccatcaccatcagcgaggacgggtccatgagcatcaagaacgaggaggaggagcacaccctgaccatcctcatccgcacgggcctgctggtgatctccggcgtgttcccggtcagcatccccatcaccgccgcggcctggtacctctgggaggtgaagaagcagcgggccggggtgctgtgggacgtccccagcccgccgcccgtgggcaaggccgagctggaggacggggcctaccgcatcaagcagcggggcatcttcgggtacagccagatcggcgcgggcgtgtacaaggaggggaccttccacaccatgtggcacgtcacccgcggcgccgtgctcatgcaccgggggaagcgcatcgagccctcctgggccgacgtgaagaaggacctgatcagctacggcgggggctggaagctggagggcgagtggaaggagggggaggaggtccaggtgctcgccctggagcccggcaagaacccccgggccgtgcagacgaagcccgggctgttcaagaccaacaccggcaccatcggggcggtctccctcgacttcagccccggcacgtccggcagccccatcgtggaccgcaaggggaaggtggtcggcctgtacgggaacggcgtggtgacccggtccggcgcctacgtcagcgccatcgcccagaccgagaagtccatcgaggacaaccccgagatcgaggacgacatcttccgcaagaagcggctgaccatcatggacctccaccccggggcgggcaagacgaagcgctacctgcccgccatcgtgcgggaggccatcaagcgcgggctgcgcaccctgatcctcgccccgacccgggtggtcgccgcggagatggaggaggccctgcgcggcctgcccatccggtaccagacccccgccatccgcgccgagcacacggggcgggagatcgtggacctcatgtgccacgccaccttcaccatgcgcctgctgtcccccgtgcgggtcccgaactacaacctcatcatcatggacgaggcgcacttcaccgaccccgccagcatcgccgcccgcggctacatctccacgcgggtggagatgggcgaggccgcggggatcttcatgaccgccacgccgcccggcagccgcgacccgttcccccagtccaacgcccccatcatggacgaggagcgggagatccccgagcgcagctggaactccgggcacgagtgggtgaccgacttcaagggcaagacggtctggttcgtgccgagcatcaaggccgggaacgacatcgcggcctgcctgcggaagaacggcaagaaggtgatccagctgtcccgcaagaccttcgacagcgagtacgtcaagacccgggccaacgactgggacttcgtggtgaccacggacatctccgagatgggcgccaacttccgcgccgagcgggtcatcgacccccgccggtgcatgaagcccgtgatcctcaccgacggggaggagcgcgtgatcctggcgggccccatgccggtcacccacagctccgccgcccagcgccgggggcgcatcggccggaaccccaagaacgagaacgaccagtacatctacatgggggagcccctggagaacgacgaggactgcgcccactggaaggaggccaagatgctcctggacaacatcaacacccccgagggcatcatcccgagcatgttcgagcccgagcgcgagaaggtggacgcgatcgacggcgagtaccggctgcgcggggaggcccggaagacgttcgtggacctcatgcgccggggcgacctgcccgtctggctggcctaccgcgtggccgccgaggggatcaactacgcggaccggcgctggtgcttcgacggcatcaagaacaaccagatcctcgaggagaacgtggaggtcgagatctggaccaaggagggggagcggaagaagctgaagccgcgctggctggacgcccggatctactccgaccccctcgccctgaaggagttcaaggagttcgccgcgggccgcaagagcctgaccctcaacctgatcaccgagatgggccggctgcccacgttcatgacccagaaggcccgcgacgccctcgacaacctggccgtgctgcacaccgccgaggtcgggggccgggcgtacaaccacgccctctccgagctgcccgagaccctggagacgctcctgctgctcaccctgctggccaccgtgaccgggggcatcttcctcttcctgatgagcggcaaggggatcggcaagatgacgctggggatgtgctgcatcatcaccgcctccatcctcctgtggtacgcccagatccagccgcactggatcgcggccagcatcatcctggagttcttcctcatcgtgctgctgatccccgagcccgagaagcagcgcacgccccaggacaaccagctcacctacgtcgtgatcgccatcctgaccgtggtcgccgccacgatggcgaacgagatgggcttcctggagaagaccaagaaggacctcgggctgggcagcatcaccacccaggagtccgagagcaacatcctggacatcgacctccggccggcctccgcctggacgctgtacgccgtggccaccaccttcgtgacccccatgctgcgccacagcatcgagaactccagcgtcaacgtgtccctcacggcgatcgccaaccaggccaccgtgctgatgggcctggggcgcggctggcccctcagcaagatggacatcggggtccccctgctggccatcggctgctactcccaggtgaacccgatcaccctcaccgcggccctgctgctcctggtggcccactacgccatcatcgggcccggcctgcaggccaaggcgacgcgggaggcccagaagcgcaccgccgccggcatcatgaagaaccccaccgtcgacgggatcaccgtgatcgacctcgagcccatcccgtacgaccccaagttcgagaagcagctgggccaggtgatgctgctcgtcctgtgcgtgacccaggtgctgatgatgcggaccacctgggccctctgcgaggcgctgaccctggccacggggcccatcagcaccctctgggagggcaaccccgggcgcttctggaacaccaccatcgccgtctccatggccaacatcttccggggcagctacctggccggcgcggggctcctgttctccatcatgaagaacacgaccaacacccgccggggcaccgggaacatgggcgagacgctgggcgagaagtggaagtcccgcctgaacgccctcgggaagtccgagttccagatctacaagaagtccggcatccaggaggtggaccggaccctggccaaggaggggatcaagcgcggcgagaccgaccaccacgccgtgtcccgggggagcgcgaagctgcgctggttcgtcgagcggaacatggtgaccccggagggcaaggtggtcgacctcggctgcgggcgcggcgggtggtcctactactgcggcgggctgaagaacgtgcgggaggtgaagggcctgacgaagggcgggcccggccacgaggagcccatccccatgagcacctacgggtggaacctcgtccgcctgcagagcggcgtggacgtgttcttcaccccgcccgagaagtgcgacaccctgctctgcgacatcggggagtccagccccaaccccacgatcgaggccggccggaccctgcgcgtcctgaacctcgtggagaactggctgaacaacaacacccagttctgcatcaaggtgctgaacccgtacatgccctccgtcatcgagaagatggagaccctccagcggaagtacggcggggccctggtgcgcaaccccctgagccgcaactccacccacgagatgtactgggtgagcaacgccacgggcaacatcgtctccagcgtgaacatgatctcccggatgctgatcaaccgcttcaccatgaagcacaagaaggccacctacgagccggacgtggacctcgggagcggcacccggaacatcgggatcgagaacgagatccccaacctggacatcatcggcaagcgcatcgagaagatcaagcaggagcacgagacgtcctggcactacgaccaggaccacccctacaagacctgggcgtaccacggcagctacgagaccaagcagaccgggtccgccagctccatggtcaacggcgtggtgaagctgctcacgaagccctgggacgtcgtgccgatggtgacccagatggccatgaccgacaccacgcccttcgggcagcagcgggtcttcaaggagaaggtggacacccgcacccaggagcccaaggagggcaccaagaagctgatgcggatcacggccgagtggctgtggaaggagctcggcaagaagaagacgccccgcatgtgcacccgggaggagttcacccgcaaggtgcggagcaacgccgcgctgggggccatcttcacggacgagaacaagtggaagtccgcccgcgaggccgtcgaggacagccggttctgggagctggtggaccgcgagcggaacctccacctggagggcaagtgcgagacctgcgtctacaacatgatggggaagcgcgagaagaagctgggcgagttcgggaaggccaagggctcccgggcgatctggtacatgtggctcggcgcccgcttcctggagttcgaggccctggggttcctcaacgaggaccactggttcagccggggcaacagcctgtccggggtggagggcgaggggctgcacaagctcggctacatcctgcgcgacgtgagcaagaaggagggcggggccatgtacgcggacgacaccgccggctgggacacccggatcacgctggaggacctcaagaacgaggagatggtcaccaaccacatgaagggggagcacaagaagctggccgaggccatcttcaagctgacctaccagaacaaggtggtgcgcgtccagcgcccgacgccccggggcacggtgatggacatcatctcccgcaaggaccagcgggggagcggccaggtgggcacctacgggctcaacaccttcaccaacatggaggcccagctgatccgccagatggagggcgaggggatcttcaagtccatccagcggctgacggtcaccgaggagatcgcggtgcagaactggctcgcccgcgtgggccgggagcgcctgagccggatggccatctccggcgacgactgcgtcgtgaagcccctggacgaccgcttcgccagcgccctcaccgcgctgaacgacatggggaaggtgcggaaggacatccagcagtgggagccctcccgcggctggaacgactggacccaggtcccgttctgcagccaccacttccacgagctggtgatgaaggacgggcgggtgctcgtcgtgccctgccgcaaccaggacgagctgatcggccgggcccgcatctcccagggggccggctggagcctgaaggagacggcctgcctcggcaagtcctacgcccagatgtggaccctgatgtacttccaccggcgcgacctgcggctcgcggccaacgccatctgcagcgccgtgccctcccactgggtccccaccagccgcaccacctggtccatccacgccaagcacgagtggatgacgaccgaggacatgctggcggtgtggaaccgcgtgtggatccaggagaacccgtggatggaggacaagacccccgtcgagagctgggaggaggtgccctacctggggaagcgggaggaccagtggtgcggcagcctcatcgggctgacctcccgcgccacgtgggccaagaacatccagaccgccatcaaccaggtgcggagcctgatcggcaacgaggagtacaccgactacatgccctccatgaagcgcttccggaaggaggaggaggaggcgggggtcctctggtga

SEQ ID NO: 9447 - RNA, 9876 nt, synthetic construct
  misc_feature 1..9876: note = derived and/or modified CDS sequence (opt1) from DENV-2__EU482724__SS-prME
  source 1..9876: mol_type = other RNA
accgccggcgtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgtcccgggcctggaacagcctcgaggtcgaggactacggcttcggggtgttctccaccaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgagatcaagagctgccactggcccaagtcccacaccctgtggagcaacggcgtgctcgagtccgagatgatcatccccaagaacttcgccgggcccgtgagccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgtccgggaagctgatcaccgagtggtgctgccggagctgcacgctgcccccgctccgctaccggggcgaggacgggtgctggtacggcatggagatccgccccctgaaggagaaggaggagaacctggtcaactccctcgtgaccgccgggcacggccagatcgacaacttcagcctgggcgtgctggggatggccctcttcctggaggagatgctgcggacccgcgtcggcaccaagcacgccatcctcctggtggcggtgtccttcgtcacgctgatcaccgggaacatgagcttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgacctccaaggagctgatgatggccaccatcggcatcgccctcctgagccagtccacgatccccgagaccatcctggagctcaccgacgccctggcgctggggatgatggtcctcaagatcgtgcgcaacatggagaagtaccagctggccgtgaccatcatggccatcagctgcgtcccgaacgccgtgatcctgcagaacgcctggaaggtgtcctgcacgatcctcgcggccgtcagcgtgagccccctgctgctcaccagctcccagcagaaggccgactggatccccctggccctgaccatcaagggcctcaaccccaccgcgatcttcctgacgaccctgagccggacctccaagaagcgcagctggccgctcaacgaggccgtcatggccgtgggcatggtgtccatcctggccagcagcctgctcaagaacgacatccccatgaccgggcccctggtcgccggcgggctgctcacggtgtgctacgtgctgaccggccggtccgcggacctggagctcgagcgcgccgccgacgtcaagtgggaggaccaggccgagatcagcgggtccagccccatcctgtccatcaccatcagcgaggacggctccatgagcatcaagaacgaggaggaggagcacaccctgacgatcctcatccggaccggcctgctggtgatctccggggtgttcccggtcagcatccccatcaccgccgcggcctggtacctctgggaggtgaagaagcagcgcgccggcgtgctgtgggacgtccccagcccgccgcccgtggggaaggccgagctggaggacggcgcctaccggatcaagcagcgcgggatcttcggctacagccagatcggcgcgggggtgtacaaggagggcaccttccacaccatgtggcacgtcacgcgcggggccgtgctcatgcaccgcggcaagcggatcgagccctcctgggccgacgtgaagaaggacctgatcagctacgggggcggctggaagctggagggggagtggaaggagggcgaggaggtccaggtgctcgccctggagcccgggaagaacccccgcgccgtgcagaccaagcccggcctgttcaagaccaacaccgggacgatcggcgcggtctccctcgacttcagccccggcacctccgggagccccatcgtggaccggaagggcaaggtggtcgggctgtacggcaacggcgtggtgacccgctccggggcctacgtcagcgccatcgcccagaccgagaagtccatcgaggacaaccccgagatcgaggacgacatcttccggaagaagcgcctgacgatcatggacctccaccccggcgcggggaagaccaagcggtacctgcccgccatcgtgcgcgaggccatcaagcggggcctgcgcaccctgatcctcgccccgacccgcgtggtcgccgcggagatggaggaggccctgcgggggctgcccatccgctaccagacgcccgccatccgggccgagcacaccggccgcgagatcgtggacctcatgtgccacgccaccttcaccatgcggctgctgtcccccgtgcgcgtcccgaactacaacctcatcatcatggacgaggcgcacttcacggaccccgccagcatcgccgcccggggctacatctccacccgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtgacggacttcaaggggaagaccgtctggttcgtgccgagcatcaaggccggcaacgacatcgcggcctgcctgcgcaagaacggcaagaaggtgatccagctgtcccggaagaccttcgacagcgagtacgtcaagacccgcgccaacgactgggacttcgtggtgacgaccgacatctccgagatgggggccaacttccgggccgagcgcgtcatcgacccccggcgctgcatgaagcccgtgatcctcaccgacggcgaggagcgggtgatcctggcggggcccatgccggtcacccacagctccgccgcccagcgccgcggccggatcgggcgcaaccccaagaacgagaacgaccagtacatctacatgggcgagcccctggagaacgacgaggactgcgcccactggaaggaggccaagatgctcctggacaacatcaacacgcccgagggcatcatcccgagcatgttcgagcccgagcgggagaaggtggacgcgatcgacggggagtaccgcctgcggggcgaggcccgcaagaccttcgtggacctcatgcggcgcggggacctgcccgtctggctggcctaccgggtggccgccgagggcatcaactacgcggaccgccggtggtgcttcgacgggatcaagaacaaccagatcctcgaggagaacgtggaggtcgagatctggaccaaggagggcgagcgcaagaagctgaagccgcggtggctggacgcccgcatctactccgaccccctcgccctgaaggagttcaaggagttcgccgcgggccggaagtccctgaccctcaacctgatcacggagatggggcgcctgcccaccttcatgacccagaaggcccgggacgccctcgacaacctggccgtgctgcacaccgccgaggtcggcgggcgcgcgtacaaccacgccctctccgagctgcccgagacgctggagaccctcctgctgctcaccctgctggccaccgtgacgggcggcatcttcctcttcctgatgagcgggaagggcatcgggaagatgaccctgggcatgtgctgcatcatcaccgcctccatcctcctgtggtacgcccagatccagccgcactggatcgcggccagcatcatcctggagttcttcctcatcgtgctgctgatccccgagcccgagaagcagcggacgccccaggacaaccagctcacctacgtcgtgatcgccatcctgacggtggtcgccgccaccatggcgaacgagatggggttcctggagaagaccaagaaggacctcggcctgggcagcatcaccacgcaggagtccgagagcaacatcctggacatcgacctccgcccggcctccgcctggaccctgtacgccgtggccaccaccttcgtgacgcccatgctgcggcacagcatcgagaactccagcgtcaacgtgtccctcaccgcgatcgccaaccaggccaccgtgctgatggggctgggccgcgggtggcccctcagcaagatggacatcggcgtccccctgctggccatcgggtgctactcccaggtgaacccgatcaccctcacggcggccctgctgctcctggtggcccactacgccatcatcggccccggcctgcaggccaaggcgacccgcgaggcccagaagcggaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcgcaccacctgggccctctgcgaggcgctgacgctggccaccggccccatcagcaccctctgggaggggaaccccggccggttctggaacaccacgatcgccgtctccatggccaacatcttccgcggcagctacctggccggggcgggcctcctcttctccatcatgaagaacaccaccaacacccggcgcgggacgggcaacatcggcgagaccctgggggagaagtggaagtcccggctgaacgccctcggcaagtccgagttccagatctacaagaagtccgggatccaggaggtggaccgcaccctggccaaggagggcatcaagcgcggggagaccgaccaccacgccgtgtcccgcggcagcgcgaagctgcggtggttcgtcgagcgcaacatggtgacgccggagggcaaggtggtcgacctcgggtgcggccgcggcgggtggtcctactactgcggcgggctgaagaacgtgcgcgaggtgaaggggctgaccaagggcgggcccgggcacgaggagcccatccccatgagcacctacggctggaacctcgtccggctgcagagcggggtggacgtgttcttcaccccgcccgagaagtgcgacacgctgctctgcgacatcggcgagtccagccccaaccccaccatcgaggccggccgcaccctgcgggtcctgaacctcgtggagaactggctgaacaacaacacccagttctgcgtgaaggtcctgaacccgtacatgccctccgtgatcgagaagatggagaccctccagcgcaagtacgggggcgccctggtgcggaaccccctgagccgcaactccacgcacgagatgtactgggtcagcaacgccaccgggaacatcgtgtccagcgtgaacatgatctcccgcatgctgatcaaccggttcaccatgaagcacaagaaggccacctacgagccggacgtcgacctcggcagcgggacgcgcaacatcggcatcgagaacgagatccccaacctggacatcatcggcaagcggatcgagaagatcaagcaggagcacgagacctcctggcactacgaccaggaccacccctacaagacctgggcgtaccacgggagctacgagaccaagcagacgggctccgccagctccatggtgaacggggtggtcaagctgctcaccaagccctgggacgtggtgccgatggtcacccagatggccatgaccgacacgacccccttcggccagcagcgcgtgttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtccgcagcaacgccgcgctgggcgccatcttcaccgacgagaacaagtggaagtccgcccgggaggccgtggaggacagccgcttctgggagctggtcgaccgggagcgcaacctccacctggaggggaagtgcgagacctgcgtgtacaacatgatgggcaagcgggagaagaagctgggggagttcggcaaggccaagggctcccgcgcgatctggtacatgtggctcggggcccggttcctggagttcgaggccctgggcttcctcaacgaggaccactggttcagccgcgggaacagcctgtccggcgtggagggggagggcctgcacaagctcggctacatcctgcgggacgtcagcaagaaggagggcggggccatgtacgcggacgacaccgccgggtgggacacgcgcatcaccctggaggacctcaagaacgaggagatggtgaccaaccacatgaagggcgagcacaagaagctggccgaggccatcttcaagctgacctaccagaacaaggtggtccgggtgcagcgcccgacgccccgcgggaccgtgatggacatcatctcccggaaggaccagcgcggcagcggccaggtcgggacctacggcctcaacaccttcacgaacatggaggcccagctgatccggcagatggagggggagggcatcttcaagtccatccagcgcctgaccgtgaccgaggagatcgcggtgcagaactggctcgcccgggtcggccgcgagcggctgagccgcatggccatctccggggacgactgcgtggtgaagcccctggacgaccggttcgccagcgccctcaccgcgctgaacgacatgggcaaggtccgcaaggacatccagcagtgggagccctcccgggggtggaacgactggacccaggtgccgttctgcagccaccacttccacgagctggtgatgaaggacggccgcgtcctcgtggtgccctgccggaaccaggacgagctgatcgggcgcgcccggatctcccagggcgccggctggagcctgaaggagaccgcctgcctcgggaagtcctacgcccagatgtggaccctgatgtacttccaccgccgggacctgcgcctcgcggccaacgccatctgcagcgccgtcccctcccactgggtgcccaccagccggaccacgtggtccatccacgccaagcacgagtggatgaccaccgaggacatgctggcggtgtggaaccgcgtctggatccaggagaacccgtggatggaggacaagacccccgtggagagctgggaggaggtgccctacctgggcaagcgcgaggaccagtggtgcgggagcctcatcggcctgacgtcccgggccacctgggccaagaacatccagaccgccatcaaccaggtccgcagcctgatcgggaacgaggagtacaccgactacatgccctccatgaagcggttccgcaaggaggaggaggaggcgggcgtgctctggtga

SEQ ID NO: 9448 - RNA, 9876 nt, synthetic construct
  misc_feature 1..9876: note = derived and/or modified CDS sequence (opt1) from DENV-2__EU482725__SS-prME
  source 1..9876: mol_type = other RNA
accgccggggtgatcatcatgctgatccccaccgccatggcgttccacctcaccacccggaacggggagccccacatgatcgtcggccggcaggagaaggggaagtccctgctgttcaagaccgaggacggcgtgaacatgtgcaccctcatggccatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccggaccgagacctggatgagcagcgagggggcctggaagcacgtccagcggatcgagacgtggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgacaccggctgcgtggtgtcctggaagaacaaggagctgaagtgcggcagcgggatcttcatcacggacaacgtccacacctggaccgagcagtacaagttccagcccgagtcccccagcaagctggcgagcgccatccagaaggcccacgaggagggcatctgcgggatccggtccgtgacccgcctcgagaacctgatgtggaagcagatcacgcccgagctgaaccacatcctcagcgagaacgaggtgaagctgaccatcatgaccggcgacatcaaggggatcatgcaggccggcaagcggtccctgcgcccgcagcccaccgagctcaagtacagctggaagacgtggggcaaggccaagatgctgtccaccgagagccacaaccagaccttcctgatcgacgggcccgagaccgcggagtgcccgaacacgaaccgggcctggaactccctcgaggtcgaggactacggcttcggggtgttcagcaccaacatctggctgaagctgcgcgagaagcaggacgtgttctgcgactccaagctcatgagcgccgccatcaaggacaaccgggccgtccacgcggacatgggctactggatcgagtccgccctgaacgacacctggaagatggagaaggccagcttcatcgagatcaagtcctgccactggcccaagagccacaccctgtggtccaacggcgtgctcgagagcgagatgatcatccccaagaacttcgccgggcccgtgtcccagcacaactaccgcccgggctaccacacccagacggccgggccctggcacctgggcaagctggagatggacttcgacttctgcgaggggaccaccgtcgtggtgaccgaggactgcggcaaccggggccccagcctccgcacgaccaccgcgagcgggaagctgatcaccgagtggtgctgccggtcctgcacgctgcccccgctccgctaccggggcgaggacgggtgctggtacggcatggagatccgccccctgaaggagaaggaggagaacctggtcaacagcctcgtgaccgccgggcacggccagatcgacaacttctccctgggcgtgctggggatggccctcttcctggaggagatgctgcggacccgcgtcggcaccaagcacgccatcctcctggtggcggtgagcttcgtcacgctgatcaccgggaacatgtccttccgggacctcggccgcgtgatggtgatggtcggggccaccatgaccgacgacatcggcatgggcgtgacgtacctggccctgctcgccgccttcaaggtgcgccccaccttcgcggccgggctgctgctccggaagctgaccagcaaggagctgatgatggccaccatcggcatcgccctcctgtcccagagcacgatccccgagaccatcctggagctcaccgacgccctggcgctggggatgatggtcctcaagatcgtgcgcaacatggagaagtaccagctggccgtgaccatcatggccatctcctgcgtcccgaacgccgtgatcctgcagaacgcctggaaggtgagctgcacgatcctcgcggccgtctccgtgagccccctgctgctcacctccagccagcagaaggccgactggatccccctggccctgaccatcaagggcctcaaccccaccgcgatcttcctgacgaccctgtcccggaccagcaagaagcgctcctggccgctcaacgaggccgtcatggccgtgggcatggtgagcatcctggcctccagcctgctcaagaacgacatccccatgaccgggcccctggtcgccggcgggctgctcacggtgtgctacgtgctgaccggccggagcgcggacctggagctcgagcgcgccgccgacgtcaagtgggaggaccaggccgagatctccgggagctcccccatcctgagcatcaccatctccgaggacggcagcatgtccatcaagaacgaggaggaggagcacaccctgacgatcctcatccggaccggcctgctggtgatcagcggggtgttcccggtctccatccccatcaccgccgcggcctggtacctctgggaggtgcgcaagcagcgggccggcgtgctgtgggacgtccccagcccgccgcccgtggggaaggccgagctggaggacggcgcctaccgcatcaagcagcgggggatcttcggctactcccagatcggcgcgggggtgtacaaggagggcaccttccacaccatgtggcacgtcacgcgcggggccgtgctcatgcaccggggcaagcgcatcgagcccagctgggccgacgtgaagaaggacctgatctcctacgggggcggctggaagctggagggggagtggaaggagggcgaggaggtccaggtgctcgccctggagcccgggaagaacccccgggccgtgcagaccaagcccggcctgttcaagaccaacaccgggacgatcggcgcggtcagcctcgacttctcccccggcaccagcgggtcccccatcgtggaccgcaagggcaaggtggtcgggctgtacggcaacggcgtggtgacccggagcggggcctacgtctccgccatcgcccagaccgagaagtccatcgaggacaaccccgagatcgaggacgacatcttccgcaagaagcggctgacgatcatggacctccaccccggcgcggggaagaccaagcgctacctgcccgccatcgtgcgggaggccatcaagcgcggcctgcgcaccctgatcctcgccccgacccgggtggtcgccgcggagatggaggaggccctgcgcgggctgcccatccggtaccagacgcccgccatccgcgccgagcacaccggccgggagatcgtggacctcatgtgccacgccaccttcaccatgcgcctgctgagccccgtgcgggtcccgaactacaacctcatcatcatggacgaggcgcacttcacggaccccgcctccatcgccgcccgcggctacatcagcacccgggtggagatgggggaggccgcgggcatcttcatgaccgccacgccgcccgggtcccgcgacccgttcccccagagcaacgcccccatcatggacgaggagcgggagatccccgagcgctcctggaacagcggccacgagtgggtgacggacttcaaggggaagaccgtctggttcgtgccgtccatcaaggccggcaacgacatcgcggcctgcctgcggaagaacggcaagaaggtgatccagctgagccgcaagaccttcgactccgagtacgtcaagacccgggccaacgactgggacttcgtggtgacgaccgacatcagcgagatgggggccaacttccgcgccgagcgggtcatcgacccccgccggtgcatgaagcccgtgatcctcaccgacggcgaggagcgcgtgatcctggcggggcccatgccggtcacccactccagcgccgcccagcgccggggccgcatcgggcggaaccccaagaacgagaacgaccagtacatctacatgggcgagcccctggagaacgacgaggactgcgcccactggaaggaggccaagatgctcctggacaacatcaacacgcccgagggcatcatcccgtccatgttcgagcccgagcgcgagaaggtggacgcgatcgacggggagtaccggctgcgcggcgaggcccggaagaccttcgtggacctcatgcgccgcggggacctgcccgtctggctggcctaccgcgtggccgccgagggcatcaactacgcggaccggcgctggtgcttcgacgggatcaagaacaaccagatcctcgaggagaacgtggaggtcgagatctggaccaaggagggcgagcggaagaagctgaagccgcgctggctggacgcccggatctacagcgaccccctcgccctgaaggagttcaaggagttcgccgcgggccgcaagtccctgaccctcaacctgatcacggagatggggcggctgcccaccttcatgacccagaaggcccgcgacgccctcgacaacctggccgtgctgcacaccgccgaggtcggcgggcgggcgtacaaccacgccctcagcgagctgcccgagacgctggagaccctcctgctgctcaccctgctggccaccgtgacgggcggcatcttcctcttcctgatgtccgggaagggcatcgggaagatgaccctgggcatgtgctgcatcatcaccgccagcatcctcctgtggtacgcccagatccagccgcactggatcgcggcctccatcatcctggagttcttcctcatcgtgctgctgatccccgagcccgagaagcagcgcacgccccaggacaaccagctcacctacgtcgtgatcgccatcctgacggtggtcgccgccaccatggcgaacgagatggggttcctggagaagaccaagaaggacctcggcctgggcagcatcaccacgcaggagagcgagtccaacatcctggacatcgacctccggccggccagcgcctggaccctgtacgccgtggccaccaccttcgtgacgcccatgctgcgccactccatcgagaacagctccgtcaacgtgagcctcaccgcgatcgccaaccaggccaccgtgctgatggggctgggccgcgggtggcccctctccaagatggacatcggcgtccccctgctggccatcgggtgctacagccaggtgaacccgatcaccctcacggcggccctgctgctcctggtggcccactacgccatcatcggccccggcctgcaggccaaggcgacccgggaggcccagaagcgcaccgccgccgggatcatgaagaaccccaccgtcgacggcatcacggtgatcgacctcgagcccatcccgtacgaccccaagttcgagaagcagctgggccaggtgatgctgctcgtcctgtgcgtgacccaggtgctgatgatgcggaccacctgggccctctgcgaggcgctgacgctggccaccggccccatctccaccctctgggaggggaaccccggccgcttctggaacaccacgatcgccgtcagcatggccaacatcttccggggctcctacctggccggggcgggcctcctcttcagcatcatgaagaacaccaccaacacccgccgggggacgggcaacatcggcgagaccctgggggagaagtggaagtcccagctgaacgccctcggcaagagcgagttccagatctacaagaagtccgggatccaggaggtggaccgcaccctggccaaggagggcatcaagcgcggggagaccgaccaccacgccgtgagccgcggctccgcgaagctgcggtggttcgtcgagcgcaacatggtgacgccggagggcaaggtggtcgacctcgggtgcggccgcggcgggtggagctactactgcggcgggctgaagaacgtgcgcgaggtgaaggggctgaccaagggcgggcccgggcacgaggagcccatccccatgtccacctacggctggaacctcgtccggctgcagagcggggtggacgtgttcttcaccccgcccgagaagtgcgacacgctgctctgcgacatcggcgagagctcccccaaccccaccatcgaggccggccgcaccctgcgggtcctgaacctcgtggagaactggctgaacaacaacacccagttctgcgtgaaggtcctgaacccgtacatgcccagcgtgatcgagaagatggagaccctccagcgcaagtacgggggcgccctggtgcggaaccccctgtcccgcaacagcacgcacgagatgtactgggtctccaacgccaccgggaacatcgtgagctccgtgaacatgatcagccgcatgctgatcaaccggttcaccatgaagcacaagaaggccacctacgagccggacgtcgacctcggctccgggacgcgcaacatcggcatcgagaacgagatccccaacctggacatcatcggcaagcggatcgagaagatcaagcaggagcacgagaccagctggcactacgaccaggaccacccctacaagacctgggcgtaccacgggtcctacgagaccaagcagacgggcagcgcctccagcatggtgaacggggtggtcaagctgctcaccaagccctgggacgtggtgccgatggtcacccagatggccatgaccgacacgacccccttcggccagcagcgcgtgttcaaggagaaggtggacacccggacccaggagcccaaggagggcacgaagaagctgatgcgcatcaccgccgagtggctgtggaaggagctcgggaagaagaagacgccccggatgtgcacccgcgaggagttcacgcggaaggtccgctccaacgccgcgctgggcgccatcttcaccgacgagaacaagtggaagtccgcccgggaggccgtggaggactcccgcttctgggagctggtcgaccgggagcgcaacctccacctggaggggaagtgcgagacctgcgtgtacaacatgatgggcaagcgggagaagaagctgggggagttcggcaaggccaagggcagccgcgcgatctggtacatgtggctcggggcccggttcctggagttcgaggccctgggcttcctcaacgaggaccactggttctcccgcgggaacagcctgagcggcgtggagggggagggcctgcacaagctcggctacatcctgcgggacgtctccaagaaggagggcggggccatgtacgcggacgacaccgccgggtgggacacgcgcatcaccctggaggacctcaagaacgaggagatggtgaccaaccacatgaagggcgagcacaagaagctggccgaggccatcttcaagctgacctaccagaacaaggtggtccgggtgcagcgcccgacgccccgcgggaccgtgatggacatcatcagccggaaggaccagcgcggctccggccaggtcgggacctacggcctcaacaccttcacgaacatggaggcccagctgatccggcagatggagggggagggcatcttcaagagcatccagcgcctgaccgtgaccgaggagatcgcggtgcagaactggctcgcccgggtcggccgcgagcggctgtcccgcatggccatcagcggggacgactgcgtggtgaagcccctggacgaccggttcgcctccgccctcaccgcgctgaacgacatgggcaaggtccgcaaggacatccagcagtgggagcccagccgggggtggaacgactggacccaggtgccgttctgctcccaccacttccacgagctggtgatgaaggacggccgcgtcctcgtggtgccctgccggaaccaggacgagctgatcgggcgcgcccggatcagccagggcgccggctggtccctgaaggagaccgcctgcctcggcaagagctacgcccagatgtggaccctgatgtacttccaccgccgggacctgcgcctcgcggccaacgccatctgctccgccgtccccagccactgggtgcccacctcccggaccacgtggagcatccacgccaagcacgagtggatgaccaccgaggacatgctggcggtgtggaaccgcgtctggatccaggagaacccgtggatggaggacaagacccccgtggagtcctgggaggaggtgccctacctgggcaagcgcgaggaccagtggtgcgggagcctcatcggcctgacgagccgggccacctgggccaagaacatccagaccgccatcaaccaggtccgctccctgatcgggaacgaggagtacaccgactacatgcccagcatgaagcggttccgcaaggaggaggaggaggcgggcgtgctctggtga

SEQ ID NO: 9449 - RNA, 9876 nt, synthetic construct
  misc_feature 1..9876: note = derived and/or modified CDS sequence (opt1) from DENV-2__EU482726__SS-prME
  source 1..9876: mol_type = other RNA
accgccggcgtgatcgtgatgctgatccccaccgtgatggccttccacctcaccacccggaacggggagccccacatgatcgtgggccggcaggagaaggggaagtccctgctgttcaagaccgaggacggcgtcaacatgtgcaccctcatggcgatcgacctgggggagctgtgcgaggacaccatcacctacaagtgccccctcctgcgccagaacgagcccgaggacatcgactgctggtgcaacagcaccagcacctgggtgacctacgggacctgcaccaccacgggcgagcaccggcgcgagaagcggtccgtggccctggtcccccacgtggggatgggcctcgagacccggaccgagacctggatgagcagcgagggggcctggaagcacgtgcagcggatcgagacgtggatcctgcgccacccgggcttcaccatcatggccgccatcctggcgtacaccatcgggaccacgcacttccagcgggccctcatcttcatcctgctgaccgccgtcgcccccagcatgaccatgcgctgcatcggcatctccaaccgggacttcgtggagggcgtgagcgggggctcctgggtcgacatcgtgctcgagcacgggagctgcgtgaccacgatggcgaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtcgaccggggctgggggaacggctgcgggctgttcggcaagggcgggatcgtgacctgcgccatgttcacgtgcaagaagaacatggagggcaagatcgtgcagcccgagaacctggagtacaccatcgtcatcacgccccacagcggggaggagcacgcggtgggcaacgacaccgggaagcacggcaaggagatcaagatcaccccgcagtccagcaccaccgaggccgagctgacggggtacggcaccgtgaccatggagtgcagcccccggaccggcctcgacttcaacgagatggtcctgctgcagatggaggacaaggcctggctcgtgcaccggcagtggttcctggacctgcccctcccctggctgccgggggccgacacgcagggcagcaactggatccagaaggagaccctggtgaccttcaagaacccccacgccaagaagcaggacgtcgtggtcctcgggtcccaggagggcgcgatgcacaccgccctgacgggggccaccgagatccagatgagcagcggcaacctcctgttcaccggccacctgaagtgccgcctgcggatggacaagctccagctgaaggggatgtcctacagcatgtgcatcggcaagttcaagatcgtgaaggagatcgccgagacccagcacgggacgatcgtgatccgcgtccagtacgagggcgacggctccccctgcaagatccccttcgagatcaccgacctggagaagcggcacgtgctcgggcgcctgatcaccgtgaacccgatcgtcaccgagaaggacgcccccgtgaacatcgaggcggagccgcccttcggcgacagctacatcatcgtgggggtcgagccgggccagctgaagctcaactggttcaagaaggggtccagcatcggccagatgttcgagacgaccatgcgcggcgccaagcggatggccatcctgggggacaccgcctgggacttcggctccctcgggggcgtgttcaccagcatcgggaaggccctccaccaggtgttcggcgcgatctacggcgccgccttctccggggtcagctggacgatgaagatcctgatcggcgtgatcatcacctggatcgggatgaactcccgcagcacctccctgagcgtgtccctggtcctcgtgggcgtggtcaccctgtacctgggggccgtggtgcaggcggacagcggctgcgtcgtgtcctggaagaacaaggagctcaagtgcggcagcgggatcttcatcacggacaacgtgcacacctggaccgagcagtacaagttccagcccgagtcccccagcaagctggccagcgccatccagaaggcccacgaggagggcatctgcgggatccggtccgtcacccgcctggagaacctcatgtggaagcagatcacgcccgagctgaaccacatcctgagcgagaacgaggtgaagctcaccatcatgaccggcgacatcaaggggatcatgcaggccggcaagcggtccctgcgcccgcagcccaccgagctgaagtacagctggaagacgtggggcaaggcgaagatgctctccaccgagagccacaaccagaccttcctgatcgacgggcccgagaccgccgagtgcccgaacacgaaccgggcctggaactccctggaggtggaggactacggcttcggggtcttcaccaccaacatctggctcaagctgcgcgagaagcaggacgtgttctgcgacagcaagctgatgtccgccgccatcaaggacaaccgggcggtgcacgccgacatgggctactggatcgagagcgccctcaacgacacctggaagatggagaaggcctccttcatcgaggtcaagagctgccactggcccaagtcccacaccctgtggagcaacggcgtgctggagtccgagatgatcatccccaagaacttcgccgggcccgtgagccagcacaactaccgcccgggctaccacacgcagaccgcggggccctggcacctcggcaagctggagatggacttcgacttctgcgaggggaccaccgtcgtggtgacggaggactgcggcaaccggggcccctccctgcgcaccaccaccgccagcgggaagctcatcacggagtggtgctgccggagctgcaccctgcccccgctgcgctaccggggcgaggacgggtgctggtacggcatggagatccgccccctcaaggagaaggaggagaacctggtcaactccctggtgaccgccgggcacggccagatcgacaacttcagcctcggcgtgctggggatggccctgttcctcgaggagatgctgcggacccgcgtcggcacgaagcacgcgaccctgctcgtggccctgtccttcgtgaccctgatcaccgggaacatgagcttccgggacctcggccgcgtcatggtgatggtgggggccacgatgaccgacgacatcggcatgggcgtcacctacctggccctgctcgccgcgttcaaggtgcgccccaccttcgccgccgggctgctgctccggaagctgacgtccaaggagctgatgatggccaccatcggcatcgccctcctgagccagtccaccctgcccgagaccatcctcgagctgacggacgcgctggccctcgggatgatggtgctgaagatcgtccgcaacatggagaagtaccagctggccgtgaccatcatggccatcagctgcgtgccgaacgccgtcatcctccagaacgcgtggaaggtgtcctgcaccatcctggccgccgtcagcgtgagccccctgctcctgaccagctcccagcagaaggccgactggatccccctggcgctcacgatcaagggcctgaaccccaccgccatcttcctgaccaccctcagccggacgtccaagaagcgcagctggccgctgaacgaggccatcatggccgtgggcatggtctccatcctggccagctccctcctgaagaacgacatccccatgaccgggcccctggtggcgggcgggctcctgaccgtgtgctacgtcctgaccggccggagcgccgacctcgagctggagcgcgccgccgacgtgaagtgggaggaccaggccgagatcagcgggtccagccccatcctgtccatcacgatcagcgaggacggctccatgagcatcaagaacgaggaggaggagcagaccctcaccatcctgatccggaccggcctgctcgtgatctccggggtcttcccggtgagcatccccatcaccgcggccgcctggtacctgtgggaggtgaagaagcagcgcgccggcgtcctgtgggacgtgcccagcccgccgcccgtggggaaggccgagctcgaggacggcgcgtaccggatcaagcagcgcgggatcctgggctacagccagatcggcgccggggtctacaaggagggcacgttccacaccatgtggcacgtgacccgcggggccgtgctgatgcaccgcggcaagcggatcgagccctcctgggccgacgtcaagaaggacctcatcagctacgggggcggctggaagctggagggggagtggaaggagggcgaggaggtccaggtgctggccctcgagcccgggaagaacccccgcgcggtccagaccaagcccggcatcttcaagacgaacaccgggaccatcggcgccgtgtccctggacttcagccccggcacctccgggagccccatcgtggaccggaagggcaaggtcgtggggctgtacggcaacggcgtggtcacgcgctccggggcctacgtgagcgccatcgcgcagaccgagaagtccatcgaggacaaccccgagatcgaggacgacatcttccggaagaagcgcctcaccatcatggacctgcaccccggcgccgggaagaccaagcggtacctgcccgccatcgtgcgcgaggccatcaagcggggcctgcgcacgctcatcctggccccgacccgcgtcgtggcggccgagatggaggaggccctgcgggggctccccatccgctaccagacccccgccatccgggccgagcacaccggccgcgagatcgtggacctgatgtgccacgcgacgttcaccatgcggctgctcagccccgtccgcgtgccgaactacaacctgatcatcatggacgaggcccacttcaccgaccccgccagcatcgccgcccggggctacatctccacccgcgtggagatgggggaggcggccggcatcttcatgacggccacgccgcccgggagccgggacccgttcccccagtccaacgcccccatcatggacgaggagcgcgagatccccgagcggagctggaactccggccacgagtgggtcaccgacttcaaggggaagaccgtgtggttcgtgccgagcatcaaggcgggcaacgacatcgccgcctgcctgcgcaagaacggcaagaaggtcatccagctctcccggaagacgttcgacagcgagtacgtgaagacccgcgccaacgactgggacttcgtggtcaccaccgacatctccgagatgggggccaacttccgggcggagcgcgtgatcgacccccggcgctgcatgaagcccgtgatcctgacggacggcgaggagcgggtcatcctggccgggcccatgccggtgacccacagctccgccgcccagcgccgcggccggatcgggcgcaaccccaagaacgagaacgaccagtacatctacatgggcgagcccctcgagaacgacgaggactgcgcccactggaaggaggcgaagatgctgctggacaacatcaacacccccgagggcatcatcccgagcatgttcgagcccgagcgggagaaggtggacgccatcgacggggagtaccgcctccggggcgaggcccgcaagaccttcgtcgacctgatgcggcgcggggacctgcccgtgtggctcgcctaccgggtggccgcggagggcatcaactacgccgaccgccggtggtgcttcgacgggatcaagaacaaccagatcctggaggagaacgtcgaggtggagatctggacgaaggagggcgagcgcaagaagctgaagccgcggtggctcgacgcccgcatctactccgaccccctggccctgaaggagttcaaggagttcgcggccggccggaagtccctcaccctgaacctgatcaccgagatggggcgcctccccaccttcatgacgcagaaggcccgggacgccctggacaacctggccgtcctccacaccgcggaggtgggcgggcgcgcctacaaccacgccctgtccgagctgcccgagaccctcgagaccctgctgctcctgacgctgctcgccaccgtgaccggcggcatcttcctgttcctgatgagcgggaagggcatcgggaagatgaccctcggcatgtgctgcatcatcaccgcctccatcctgctgtggtacgcgcagatccagccgcactggatcgccgccagcatcatcctcgagttcttcctgatcgtcctgctcatccccgagcccgagaagcagcggacgccccaggacaaccagctgacctacgtggtgatcgccatcctgaccgtcgtggccgcgaccatggccaacgagatggggttcctcgagaagacgaagaaggacctgggcctgggctccatcaccacccaggagagcgagagcaacatcctcgacatcgacctgcgcccggcctccgcctggaccctgtacgccgtggcgacgaccttcgtcacccccatgctccggcacagcatcgagaactccagcgtgaacgtgtccctgaccgccatcgccaaccaggccacggtcctgatggggctcggccgcgggtggcccctgagcaagatggacatcggcgtgcccctgctcgcgatcgggtgctactcccaggtgaacccgatcaccctgaccgccgccctgctcctgctggtcgcccactacgccatcatcggccccggcctccaggcgaaggccacccgcgaggcccagaagcggacggccgccgggatcatgaagaaccccaccgtggacggcatcaccgtgatcgacctggagcccatcccgtacgaccccaagttcgagaagcagctggggcaggtcatgctcctggtgctgtgcgtgacccaggtcctcatgatgcgcacgacctgggcgctgtgcgaggccctgaccctcgccaccggccccatcagcacgctgtgggaggggaaccccggccggttctggaacaccaccatcgccgtgtccatggccaacatcttccgcggcagctacctggcgggggccggcctcctgttctccatcatgaagaacaccacgaacacccggcgcgggaccggcaacatcggcgagaccctgggggagaagtggaagtcccggctcaacgccctgggcaagtccgagttccagatctacaagaagtccgggatccaggaggtggaccgcacgctggccaaggagggcatcaagcgcggggagaccgaccaccacgcggtctcccgcggcagcgccaagctccggtggttcgtggagcgcaacatggtgaccccggagggcaaggtcgtggacctggggtgcggccgcgggggctggtcctactactgcgggggcctgaagaacgtgcgcgaggtcaagggcctcaccaagggcggccccgggcacgaggagcccatccccatgagcacgtacggctggaacctggtgcggctgcagtccggggtggacgtcttcttcaccccgcccgagaagtgcgacaccctcctgtgcgacatcggcgagagcagccccaaccccaccatcgaggccggccgcaccctgcgggtgctcaacctggtggagaactggctgaacaacaacacgcagttctgcatcaaggtcctcaacccgtacatgccctccgtgatcgagaagatggagaccctgcagcgcaagtacgggggcgccctggtgcggaaccccctgagccgcaactccacccacgagatgtactgggtcagcaacgccaccgggaacatcgtgtccagcgtgaacatgatctcccgcatgctcatcaaccggttcacgatgaagcacaagaaggcgacctacgagccggacgtcgacctgggcagcgggacccgcaacatcggcatcgagtccgagatccccaacctggacatcatcggcaagcggatcgagaagatcaagcaggagcacgagaccagctggcactacgaccaggaccacccctacaagacgtgggcctaccacgggtcctacgagaccaagcagaccggcagcgcctccagcatggtgaacggggtggtcaagctcctgaccaagccctgggacgtggtgccgatggtcacgcagatggccatgaccgacaccacccccttcggccagcagcgcgtgttcaaggagaaggtggacacgcggacccaggagcccaaggagggcaccaagaagctgatgcgcatcaccgccgagtggctctggaaggagctggggaagaagaagacgccccggatgtgcacccgcgaggagttcacccggaaggtccgctccaacgcggccctgggcgccatcttcaccgacgagaacaagtggaagtccgcccgggaggccgtggaggactcccgcttctgggagctcgtcgaccgggagcgcaacctgcacctggaggggaagtgcgagacgtgcgtgtacaacatgatgggcaagcgggagaagaagctcggggagttcggcaaggcgaagggcagccgcgccatctggtacatgtggctgggggcccggttcctggagttcgaggccctcggcttcctgaacgaggaccactggttctcccgcgggaacagcctgagcggcgtggagggggagggcctccaccggctgggctacatcctgcgcgaggtcgggaagaaggagggcggggcgatgtacgccgacgacaccgccggctgggacacccggatcaccctcgaggacctgaagaacgaggagatggtgacgaaccacatgaagggggagcacaagaagctggccgaggccatcttcaagctcacctaccagaacaaggtggtccgcgtgcagcgcccgacgccccggggcaccgtgatggacatcatctcccgcaaggaccagcggggcagcgggcaggtcggcacgtacgggctgaacaccttcaccaacatggaggcgcagctgatccgccagatggagggcgagggcatcttcaagtccatccagcacctcaccgccacggaggagatcgccgtgcagaactggctggcccgggtggggcgcgagcggctgagccgcatggccatctccggcgacgactgcgtcgtgaagcccatcgacgaccggttcgcgagcgccctcaccgccctgaacgacatggggaaggtgcgcaaggacatccagcagtgggagccctcccggggctggaacgactggacccaggtcccgttctgcagccaccacttccacgagctggtgatgaaggacgggcgcgtgctcgtcgtgccctgccggaaccaggacgagctgatcggccgcgcccggatctcccagggcgccgggtggagcctgaaggagaccgcgtgcctcggcaagtcctacgcccagatgtggaccctgatgtacttccaccgccgggacctgcgcctcgccgccaacgccatctgcagcgcggtgccctcccactgggtccccacgagccggaccacctggtccatccacgccaagcacgagtggatgaccacggaggacatgctggccgtgtggaaccgcgtgtggatccaggagaacccgtggatggaggacaagacccccgtcgagagctgggaggaggtgccctacctggggaagcgcgaggaccagtggtgcggctccctcatcgggctgaccagccgggccacctgggcgaagaacatccagacggccatcaaccaggtgcgcagcctgatcggcaacgaggagtacaccgactacatgccctccatgaagcggttccgccgggaggaggaggaggccggcgtcctctggtga

SEQ ID NO: 9450 - RNA, 9876 nt, synthetic construct
  misc_feature 1..9876: note = derived and/or modified CDS sequence (opt1) from DENV-2__EU482727__SS-prME
  source 1..9876: mol_type = other RNA
accgccggcgtgatcatcatgctgatccccaccgccatggcgttccacctcaccacccgcaacggggagccccacatgatcgtgggccggcaggagaaggggaagtccctgctgttcaagaccgaggacggcgtgaacatgtgcaccctcatggccatcgacctgggggagctgtgcgaggacaccatcacctacaagtgccccctcctgcggcagaacgagcccgaggacatcgactgctggtgcaacagcaccagcacctgggtgacctacgggacctgcaccaccacgggcgagcaccggcgcgagaagcggtccgtcgccctggtgccccacgtggggatgggcctcgagacccgcaccgagacctggatgagcagcgagggggcctggaagcacgtccagcggatcgagacctggatcctgcgccacccgggcttcaccatcatggccgcgatcctggcctacaccatcgggaccacgcacttccagcgggccctcatcttcatcctgctgaccgccgtggcgcccagcatgaccatgcgctgcatcggcatctccaaccgggacttcgtggagggcgtcagcgggggctcctgggtggacatcgtgctcgagcacgggagctgcgtcaccacgatggccaagaacaagcccaccctggacttcgagctgatcaagaccgaggccaagcagcccgccaccctccgcaagtactgcatcgaggccaagctgacgaacaccaccaccgagtcccggtgcccgacgcagggcgagcccagcctgaacgaggagcaggacaagcgcttcatctgcaagcactccatggtggaccggggctgggggaacggctgcggcctgttcggcaagggcgggatcgtgacctgcgcgatgttcacgtgcaagaagaacatggagggcaaggtcgtgctgcccgagaacctggagtacaccatcgtgatcacgccccacagcggggaggagcacgccgtcggcaacgacaccgggaagcacggcaaggagatcaagatcaccccgcagtccagcatcaccgaggccgagctcaccgggtacggcacggtgaccatggagtgcagcccccggaccggcctggacttcaacgagatggtgctgctccagatggaggacaaggcctggctggtccaccggcagtggttcctggacctccccctgccctggctgccgggggccgacacccagggcagcaactggatccagaaggagacgctcgtgaccttcaagaacccccacgcgaagaagcaggacgtggtcgtgctggggtcccaggagggcgccatgcacaccgccctgaccggggccacggagatccagatgagcagcggcaacctcctgttcaccggccacctgaagtgccgcctccggatggacaagctgcagctgaaggggatgtcctacagcatgtgcaccggcaagttcaagatcgtcaaggagatcgccgagacccagcacgggacgatcgtgatccgcgtgcagtacgagggcgacggctccccctgcaagatccccttcgagatcatggacctcgagaagcggcacgtcctggggcgcctgatcaccgtgaacccgatcgtgaccgagaaggacagccccgtcaacatcgaggcggagccgcccttcggcgactcctacatcatcatcggggtggagccgggccagctcaagctgaactggttcaagaaggggagctccatcggccagatgttcgagaccacgatgcgcggcgccaagcggatggccatcctgggggacaccgcctgggacttcggcagcctcgggggcgtgttcacctccatcgggaaggccctgcaccaggtcttcggcgcgatctacggcgccgccttcagcggggtgtcctggaccatgaagatcctgatcggcgtgatcatcacgtggatcgggatgaacagccgctccaccagcctgtccgtcagcctcgtgctggtgggcgtcgtgaccctgtacctcggggtgatggtccaggccgactccggctgcgtggtgagctggaagaacaaggagctgaagtgcggctccgggatcttcatcaccgacaacgtccacacgtggaccgagcagtacaagttccagcccgagagccccagcaagctggcgtccgccatccagaaggcccacgaggagggcatctgcgggatccggagcgtgacccgcctcgagaacctgatgtggaagcagatcacccccgagctgaaccacatcctctccgagaacgaggtgaagctgacgatcatgaccggcgacatcaaggggatcatgcaggccggcaagcggagcctgcgcccgcagcccaccgagctcaagtactcctggaagacctggggcaaggccaagatgctgagcacggagtcccacaaccagaccttcctgatcgacgggcccgagaccgcggagtgcccgaacaccaaccgggcctggaacagcctcgaggtcgaggactacggcttcggggtgttctccacgaacatctggctgaagctgcgcgagaagcaggacgtgttctgcgacagcaagctcatgtccgccgccatcaaggacaaccgggccgtccacgcggacatgggctactggatcgagagcgccctgaacgacacctggaagatggagaaggcctccttcatcgaggtcaagagctgccactggcccaagtcccacaccctgtggagcaacggcgtgctcgagtccgagatgatcatccccaagaacttcgccgggcccgtgagccagcacaactaccgcccgggctaccacacccagaccgccgggccctggcacctgggcaagctggagatggacttcgacttctgcgaggggacgaccgtggtggtcaccgaggactgcggcaaccggggccccagcctccgcaccacgaccgcgtccgggaagctgatcaccgagtggtgctgccggagctgcaccctgcccccgctccgctaccggggcgaggacgggtgctggtacggcatggagatccgccccctgaaggagaaggaggagaacctggtgaactccctcgtgacggccgggcacggccagatcgacaacttcagcctgggcgtcctggggatggccctcttcctggaggagatgctgcggacccgcgtgggcaccaagcacgccatcctcctggtggcggtctccttcgtgaccctgatcacggggaacatgagcttccgggacctcggccgcgtgatggtcatggtgggggccaccatgaccgacgacatcggcatgggcgtgacctacctggccctgctcgccgccttcaaggtccgccccacgttcgcggccgggctgctgctccggaagctgacctccaaggagctgatgatggccaccatcggcatcgccctcctgagccagtccaccatccccgagacgatcctggagctcaccgacgccctggcgctggggatgatggtgctcaagatcgtgcgcaacatggagaagtaccagctggccgtcaccatcatggccatcagctgcgtgccgaacgccgtgatcctgcagaacgcctggaaggtctcctgcaccatcctcgcggccgtgagcgtcagccccctgctgctcacgagctcccagcagaaggccgactggatccccctggccctgaccatcaagggcctcaaccccaccgcgatcttcctgaccacgctgagccggacctccaagaagcgcagctggccgctcaacgaggccgtgatggccgtgggcatggtctccatcctggccagcagcctgctcaagaacgacatccccatgaccgggcccctggtggccggcgggctgctcaccgtgtgctacgtcctgacgggccggtccgcggacctggagctcgagcgcgccgccgacgtgaagtgggaggaccaggccgagatcagcgggtccagccccatcctgtccatcaccatcagcgaggacggctccatgagcatcaagaacgaggaggaggagcagaccctgaccatcctcatccggacgggcctgctggtgatctccggggtcttcccggtgagcatccccatcaccgccgcggcctggtacctctgggaggtgaagaagcagcgcgccggcgtcctgtgggacgtgcccagcccgccgcccgtggggaaggccgagctggaggacggcgcctaccggatcaagcagcgcgggatcttcggctacagccagatcggcgcgggggtctacaaggagggcaccttccacaccatgtggcacgtgacccgcggggccgtgctcatgcaccgcggcaagcggatcgagccctcctgggccgacgtcaagaaggacctgatcagctacgggggcggctggaagctggagggggagtggaaggagggcgaggaggtccaggtgctcgccctggagcccgggaagaacccccgcgccgtccagacgaagcccggcctgttcaagaccaacaccgggaccatcggcgcggtgtccctcgacttcagccccggcacgtccgggagccccatcgtggaccggaagggcaaggtcgtggggctgtacggcaacggcgtggtcacccgctccggggcctacgtgagcgccatcgcccagaccgagaagtccatcgaggacaaccccgagatcgaggacgacatcttccggaagaagcgcctgaccatcatggacctccaccccggcgcggggaagacgaagcggtacctgcccgccatcgtgcgcgaggccatcaagcggggcctgcgcaccctgatcctcgccccgacccgcgtcgtggccgcggagatggaggaggccctgcgggggctgcccatccgctaccagacccccgccatccgggccgagcacacgggccgcgagatcgtggacctcatgtgccacgccaccttcaccatgcggctgctgtcccccgtccgcgtgccgaactacaacctcatcatcatggacgaggcgcacttcaccgaccccgccagcatcgccgcccggggctacatctccacgcgcgtggagatgggggaggccgcgggcatcttcatgaccgccacgccgcccgggagccgggacccgttcccccagtccaacgcccccatcatggacgaggagcgcgagatccccgagcggagctggaactccggccacgagtgggtcaccgacttcaaggggaagacggtgtggttcgtgccgagcatcaaggccggcaacgacatcgcggcctgcctgcgcaagaacggcaagaaggtcatccagctgtcccggaagaccttcgacagcgagtacgtgaagacccgcgccaacgactgggacttcgtggtcaccacggacatctccgagatgggggccaacttccgggccgagcgcgtgatcgacccccggcgctgcatgaagcccgtgatcctcaccgacggcgaggagcgggtcatcctggcggggcccatgccggtgacccacagctccgccgcccagcgccgcggccggatcgggcgcaaccccaagaacgagaacgaccagtacatctacatgggcgagcccctggagaacgacgaggactgcgcctactggaaggaggccaagatgctcctggacaacatcaacacccccgagggcatcatcccgagcatgttcgagcccgagcgggagaaggtggacgcgatcgacggggagtaccgcctgcggggcgaggcccgcaagacgttcgtcgacctcatgcggcgcggggacctgcccgtgtggctggcctaccgggtggccgccgagggcatcaactacgcggaccgccggtggtgcttcgacgggatcaagaacaaccagatcctcgaggagaacgtcgaggtggagatctggaccaaggagggcgagcgcaagaagctgaagccgcggtggctggacgcccgcatctactccgaccccctcgccctgaaggagttcaaggagttcgccgcgggccggaagtccctgaccctcaacctgatcaccgagatggggcgcctgcccacgttcatgacccagaaggcccgggacgccctcgacaacctggccgtcctgcacaccgccgaggtgggcgggcgcgcgtacaaccacgccctctccgagctgcccgagaccctggagacgctcctgctgctcaccctgctggccaccgtgaccggcggcatcttcctcttcctgatgagcgggaagggcatcgggaagatgacgctgggcatgtgctgcatcatcaccgcctccatcctcctgtggtacgcccagatccagccgcactggatcgcggccagcatcatcctggagttcttcctcatcgtcctgctgatccccgagcccgagaagcagcggacgccccaggacaaccagctcacctacgtggtgatcgccatcctgaccgtcgtggccgccacgatggcgaacgagatggggttcctggagaagaccaagaaggacctcggcctgggcagcatcaccacccaggagtccgagagcaacatcctggacatcgacctccgcccggcctccgcctggacgctgtacgccgtggccaccaccttcgtcacccccatgctgcggcacagcatcgagaactccagcgtgaacgtgtccctcacggcgatcgccaaccaggccaccgtcctgatggggctgggccgcgggtggcccctcagcaagatggacatcggcgtgcccctgctggccatcgggtgctactcccaggtgaacccgatcaccctcaccgcggccctgctgctcctggtcgcccactacgccatcatcggccccggcctgcaggccaaggcgacgcgcgaggcccagaagcgggccgccgccgggatcatgaagaaccccaccgtggacggcatcaccgtgatcgacctcgagcccatcccgtacgaccccaagttcgagaagcagctggggcaggtcatgctgctcgtgctgtgcgtgacccaggtcctgatgatgcgcacgacctgggcgctctgcgaggccctgaccctggccaccggccccatcagcacgctctgggaggggaaccccggccggttctggaacaccaccatcgccgtgtccatggccaacatcttccgcggcagctacctggcgggggccggcctcctcttctccatcatgaagaacaccacgaacacccggcgcgggaccggcaacatcggcgagaccctgggggagaagtggaagtcccggctgaacgccctcggcaagtccgagttccagatctacaagaagtccgggatccaggaggtggaccgcacgctggccaaggagggcatcaagcgcggggagaccgaccaccacgcggtctcccgcggcagcgccaagctgcggtggttcgtggagcgcaacatggtgaccccggagggcaaggtcgtggacctcgggtgcggccgcggcgggtggtcctactactgcggcgggctgaagaacgtgcgcgaggtcaaggggctgaccaagggcggccccgggcacgaggagcccatccccatgagcacgtacggctggaacctcgtgcggctgcagagcggggtggacgtcttcttcaccccgcccgagaagtgcgacaccctgctctgcgacatcggcgagtccagccccaaccccaccatcgaggccggccgcacgctgcgggtgctgaacctcgtggagaactggctgaacaacaacacccagttctgcatcaaggtcctgaacccgtacatgccctccgtgatcgagaagatggagaccctccagcgcaagtacgggggcgccctggtgcggaaccccctgagccgcaactccacccacgagatgtactgggtcagcaacgccaccgggaacatcgtgtccagcgtgaacatgatctcccgcatgctgatcaaccggttcacgatgaagcacaagaaggcgacctacgagccggacgtcgacctcggcagcgggacccgcaacatcggcatcgagaacgagatccccaacctggacatcatcggcaagcggatcgagaagatcaagcaggagcacgagacctcctggcactacgaccaggaccacccctacaagacgtgggcctaccacgggagctacgagaccaagcagaccggctccgccagctccatggtgaacggggtggtccgcctgctcaccaagccctgggacgtggtgccgatggtcacgcagatggccatgaccgacaccacccccttcggccagcagcgggtgttcaaggagaaggtggacacgcgcacccaggagcccaaggagggcaccaagaagctgatgcggatcaccgccgagtggctgtggaaggagctcgggaagaagaagacgccccgcatgtgcacccgggaggagttcacccgcaaggtccggagcaacgcggccctgggcgccatcttcaccgacgagaacaagtggaagtccgcccgcgaggccgtggaggacagccggttctgggagctggtcgaccgcgagcggaacctccacctggaggggaagtgcgagacgtgcgtgtacaacatgatgggcaagcgcgagaagaagctgggggagttcggcaaggcgaagggctcccgggccatctggtacatgtggctcggggcccgcttcctggagttcgaggccctgggcttcctcaacgaggaccactggttcagccggcgcaacagcctgtccggggtggagggcgaggggctgcacaagctcggctacatcctgcgggacgtcagcaagaaggagggcggggcgatgtacgccgacgacaccgccggctgggacacccgcatcaccctggaggacctcaagaacgaggagatggtgacgaaccacatgaagggggagcacaagaagctggccgaggccatcttcaagctgacctaccagaacaaggtggtccgcgtgcagcggccgacgccccggggcaccgtgatggacatcatctcccggaaggaccagcgcgggagcggccaggtcggcacgtacgggctcaacaccttcaccaacatggaggcgcagctgatccggcagatggagggcgaggggatcttcaagtccatccagcgcctgaccgtgacggaggagatcgccgtgcagaactggctcgcccgggtcggccgcgagcggctgagccgcatggccatctccggcgacgactgcgtggtgaagcccctggacgaccggttcgccagcgcgctcaccgccctgaacgacatggggaaggtccgcaaggacatccagcagtgggagccctcccggggctggaacgactggacccaggtgccgttctgcagccaccacttccacgagctggtgatgaaggacgggcgcgtcctcgtggtgccctgccggaaccaggacgagctgatcggccgcgcccggatctcccagggggccggctggagcctgaaggagaccgcctgcctcggcaagtcctacgcgcagatgtggacgctgatgtacttccaccgccgggacctgcgcctcgccgccaacgccatctgcagcgccgtcccctcccactgggtgcccaccagccgcaccacctggtccatccacgcgaagcacgagtggatgaccacggaggacatgctggccgtgtggaaccgggtctggatccaggagaacccgtggatggaggacaagacccccgtggagagctgggaggaggtgccctacctggggaagcgcgaggaccagtggtgcggcagcctcatcgggctgacctcccgggccacctgggccaagaacatccagacggcgatcaaccaggtccgcagcctgatcggcaacgaggagtacaccgactacatgccctccatgaagcggttccgcaaggaggaggaggaggccggggtgctctggtga
